US008932598B2

(12) United States Patent
Song et al.

(10) Patent No.: US 8,932,598 B2
(45) Date of Patent: Jan. 13, 2015

(54) FUSION PROTEINS AND METHODS OF USE

(71) Applicant: VaxInnate Corporation, Cranbury, NJ (US)

(72) Inventors: Langzhou Song, Cranbury, NJ (US); Ge Liu, Cranbury, NJ (US); Scott Umlauf, Cranbury, NJ (US); Uma Kavita, Cranbury, NJ (US); Hong Li, Cranbury, NJ (US); Xiangyu Liu, Cranbury, NJ (US); Bruce Weaver, Cranbury, NJ (US); Lynda Tussey, Cranbury, NJ (US)

(73) Assignee: VaxInnate Corporation, Cranbury, NJ (US)

(*) Notice: Subject to any disclaimer, the term of this patent is extended or adjusted under 35 U.S.C. 154(b) by 0 days.

(21) Appl. No.: 13/931,028

(22) Filed: Jun. 28, 2013

(65) Prior Publication Data

US 2014/0065177 A1 Mar. 6, 2014
US 2014/0255438 A9 Sep. 11, 2014

Related U.S. Application Data

(60) Provisional application No. 61/743,165, filed on Aug. 28, 2012.

(51) Int. Cl.
| C12N 15/62 | (2006.01) |
| C07K 14/005 | (2006.01) |
| C07K 14/255 | (2006.01) |
| A61K 39/145 | (2006.01) |
| A61K 39/39 | (2006.01) |
| C07K 14/195 | (2006.01) |
| A61K 39/00 | (2006.01) |

(52) U.S. Cl.
CPC ............ *C07K 14/005* (2013.01); *A61K 39/145* (2013.01); *A61K 39/39* (2013.01); *C07K 14/255* (2013.01); *C07K 14/195* (2013.01); *C07K 2319/00* (2013.01); *C07K 2319/40* (2013.01); *C07K 2319/74* (2013.01); *A61K 2039/6068* (2013.01); *C12N 2760/16234* (2013.01); *C12N 2760/16222* (2013.01)
USPC ................. 424/186.1; 424/184.1; 424/185.1; 424/192.1; 435/69.7; 435/440; 435/235.1; 435/252.3; 530/350

(58) Field of Classification Search
None
See application file for complete search history.

(56) References Cited

U.S. PATENT DOCUMENTS

| 4,474,757 A | 10/1984 | Arnon et al. |
| 4,625,015 A | 11/1986 | Green et al. |
| 4,659,669 A | 4/1987 | Kleid et al. |
| 4,752,473 A | 6/1988 | Nayak et al. |
| 5,612,037 A | 3/1997 | Huebner et al. |
| 5,762,939 A | 6/1998 | Smith et al. |
| 5,962,298 A | 10/1999 | Fiers et al. |
| 5,976,552 A | 11/1999 | Volvovitz |
| 6,130,082 A | 10/2000 | Majarian et al. |
| 6,194,546 B1 | 2/2001 | Newton et al. |
| 6,245,532 B1 | 6/2001 | Smith et al. |
| 6,337,070 B1 | 1/2002 | Okuno et al. |
| 6,605,457 B1 | 8/2003 | Fiers et al. |
| 6,740,325 B1 | 5/2004 | Arnon et al. |
| 7,192,595 B2 | 3/2007 | Arnon et al. |
| 7,404,963 B2 | 7/2008 | Sotomayor et al. |
| 7,468,259 B2 | 12/2008 | Fiers et al. |
| 7,514,086 B2 | 4/2009 | Arnon et al. |
| 7,556,940 B2 | 7/2009 | Galarza et al. |
| 7,731,972 B1 | 6/2010 | Neirynck et al. |
| 7,732,130 B2 | 6/2010 | Neirynck et al. |
| 7,794,731 B2 | 9/2010 | Mizel et al. |
| 8,017,127 B2 | 9/2011 | Birkett |
| 8,420,102 B2 * | 4/2013 | Song et al. ............. 424/201.1 |
| 8,574,588 B2 | 11/2013 | Powell et al. |
| 2003/0044429 A1 | 3/2003 | Aderem et al. |
| 2003/0099668 A1 | 5/2003 | Bachmann et al. |
| 2004/0116664 A1 | 6/2004 | De Filette et al. |
| 2004/0223976 A1 | 11/2004 | Bianchi et al. |
| 2005/0009008 A1 | 1/2005 | Robinson et al. |
| 2005/0147627 A1 | 7/2005 | Aderem et al. |
| 2007/0042001 A1 | 2/2007 | Weeks-Levy et al. |
| 2007/0042002 A1 | 2/2007 | Weeks-Levy et al. |
| 2007/0160623 A1 | 7/2007 | Medzhitov et al. |
| 2007/0253982 A1 * | 11/2007 | Song et al. ............. 424/209.1 |
| 2008/0008725 A1 | 1/2008 | Weeks-Levy et al. |

(Continued)

FOREIGN PATENT DOCUMENTS

| AU | A-49273/90 | 8/1990 |
| EP | 0 222 835 B2 | 9/1994 |

(Continued)

OTHER PUBLICATIONS

Luo C, Nobusawa E, Nakajima K. Analysis of the desialidation process of the haemagglutinin protein of influenza B virus: the host-dependent desialidation step. J Gen Virol. Jul. 2003;83(Pt 7):1729-34.*

McClelland M, et. al. Complete genome sequence of *Salmonella enterica* serovar Typhimurium LT2. Nature. Oct. 25, 2001:413(6858):852-6.*

McClelland M, et. al. *Salmonella typhimurium* flagellin. GenBank Dep. No. NP_461698. Dep. Nov. 7, 2001.*

Taylor DN, Umlauf S, Tussey L, Treanor J, Kavita U, Song L, Liu G, Ozer K, Sheldon EA, Johnson C, Hofstaetter T, Shaw A. Development of an Influenza HA-flagellin fusion vaccine with improved safety and immune response. 49th Annual Meeting of the Infectious (Continued)

*Primary Examiner* — Benjamin P Blumel
*Assistant Examiner* — Rachel Gill
(74) *Attorney, Agent, or Firm* — Hamilton, Brook, Smith & Reynolds, P.C.

(57) ABSTRACT

Compositions that include a fusion protein comprising flagellin and at least one antigen that has an isoelectric point greater than about 7.0 and that is fused to at least one domain 3 of the flagellin activate Toll-like Receptor 5. Methods of stimulating an immune response, in particular, a protective immune response include administering a composition that includes an antigen fused to a loop of domain 3 of flagellin.

24 Claims, 47 Drawing Sheets

(56) References Cited

U.S. PATENT DOCUMENTS

| | | | |
|---|---|---|---|
| 2008/0193487 | A1 | 8/2008 | Schild et al. |
| 2008/0220011 | A1 | 9/2008 | Mizel |
| 2008/0226667 | A1 | 9/2008 | Medzhitov |
| 2009/0081725 | A1 | 3/2009 | Powell et al. |
| 2009/0162400 | A1 | 6/2009 | Powell et al. |
| 2009/0297552 | A1 | 12/2009 | Aderem et al. |
| 2010/0015170 | A1 | 1/2010 | Takeshita et al. |
| 2011/0008383 | A1 | 1/2011 | Powell et al. |
| 2011/0117128 | A1 | 5/2011 | Powell et al. |
| 2011/0135680 | A1 | 6/2011 | Song et al. |
| 2012/0237544 | A1* | 9/2012 | Cutting et al. ............. 424/208.1 |
| 2013/0095130 | A1* | 4/2013 | Taylor et al. ............... 424/186.1 |
| 2013/0136763 | A1* | 5/2013 | Song et al. .................. 424/192.1 |
| 2013/0224798 | A1* | 8/2013 | Song et al. .................... 435/69.7 |
| 2013/0330367 | A1* | 12/2013 | Song et al. ................. 424/185.1 |
| 2013/0331548 | A1 | 12/2013 | Nakaar et al. |
| 2014/0037683 | A1* | 2/2014 | Powell et al. ............. 424/218.1 |
| 2014/0205624 | A1 | 7/2014 | Song et al. |
| 2014/0235836 | A1 | 8/2014 | Song et al. |

FOREIGN PATENT DOCUMENTS

| | | |
|---|---|---|
| EP | 0 419 513 B1 | 4/1995 |
| EP | 0 621 339 B1 | 10/2001 |
| EP | 0 833 933 B1 | 9/2005 |
| WO | WO 88/01873 A1 | 3/1988 |
| WO | WO 89/10967 A1 | 11/1989 |
| WO | WO 93/20846 A1 | 10/1993 |
| WO | WO 96/33738 | 10/1996 |
| WO | WO 98/23288 A1 | 6/1998 |
| WO | WO 98/48026 A1 | 10/1998 |
| WO | WO 00/32228 A2 | 6/2000 |
| WO | WO 01/40280 A2 | 6/2001 |
| WO | WO 02/09748 A1 | 2/2002 |
| WO | WO 02/085933 A1 | 10/2002 |
| WO | WO 03/051305 A2 | 6/2003 |
| WO | WO 2004/076621 A2 | 9/2004 |
| WO | WO 2004/080403 A2 | 9/2004 |
| WO | WO 2005/042564 A1 | 5/2005 |
| WO | WO 2006/040076 A2 | 4/2006 |
| WO | WO 2006/069262 A2 | 6/2006 |
| WO | WO 2006/077448 A1 | 7/2006 |
| WO | WO 2006/081007 A2 | 8/2006 |
| WO | WO 2006/083706 A2 | 8/2006 |
| WO | WO 2006/083792 A2 | 8/2006 |
| WO | WO 2007/022425 A2 | 2/2007 |
| WO | WO 2007/066334 A1 | 6/2007 |
| WO | WO 2007/085969 | 8/2007 |
| WO | WO 2007/125535 A1 | 11/2007 |
| WO | WO 2008/121926 A1 | 10/2008 |
| WO | WO 2009/128950 A2 | 10/2009 |
| WO | WO 2009/130618 | 10/2009 |
| WO | WO 2013/019800 A1 | 2/2013 |
| WO | WO 2013/066365 A1 | 5/2013 |

OTHER PUBLICATIONS

Diseases Society of America. Oct. 20-23, 2011. Boston, MA, USA.*
Mizel, S. B. and Bates, J. T., "Flagellin as an Adjuvant: Cellular Mechanisms and Potential," *J. Immunol.*, 185(10):5677-5682 (Nov. 2010).
Song, L., et al., "Superior Efficacy of a Recombinant Flagellin: H5N1 HA Globular Head Vaccine Is Determined by the Placement of the Globular Head within Flagellin," *Vaccine*, 27(42):5875-5884 (Sep. 2009).
Treanor, J. J., et al., "Safety and Immunogenicity of a Recombinant Hemagglutinin Influenza-Flagellin Fusion Vaccine (VAX125) in Healthy Young Adults," *Vaccine*, 28(52):8268-8274 (Dec. 2010).
Written Opinion of the International Searching Authority for International Application No. PCT/US2013/056838, "Flagellin Fusion Proteins and Methods of Use," Issued on Dec. 11, 2013, 12 pages.
Conne, P., et al., "Immunogenicity of trivalent subunit versus virosome-formulated influenza vaccines in geriatric patients," *Vaccine*, 15(15): 1675-1679 (1997).

Samatey, F. A., et al., "Structure of the bacterial flagellar protofilament and implications for a switch for supercoiling," *Nature*, 410(6826): 331-337 (2001).
Taylor, D. N., et al., "Development of VAX128, a recombinant hemagglutinin (HA) influenza-flagellin fusion vaccine with improved safety and immune response," *Vaccine* (2012), http://dx.doi.org/10.1016/j.vaccine.2012.06.086.
Akira, S. and Hemmi, H., "Recognition of Pathogen-Associated Molecular Patterns by TLR Family," *Immunology Letters*, 85:85-95 (2003).
Andersen-Nissen, E., et al., "A Conserved Surface on Toll-like Receptor 5 Recognizes Bacterial Flagellin," *J. Exp. Med.*, 204(2):393-403 (Feb. 2007).
Andersen-Nissen, E., et al., "Evasion of Toll-like Receptor 5 by Flagellated Bacteria," *Proc. Natl. Acad. Sci. USA*, 102(26):9247-9252 (Jun. 2005).
Applequist, S. E., et al., "Activation of Innate Immunity, Inflammation, and Potentiation of DNA Vaccination through Mammalian Expression of the TLR5 Agonist Flagellin," *J. Immunol.*, 175:3882-3891 (2005).
Arnon, R., et al., "Peptide-based Synthetic Recombinant Vaccines with Anti-viral Efficacy," *Biologicals*, 29:237-242 (2001).
Bargieri, D.Y., et al., "New Malaria Vaccine Candidates Based on the *Plasmodium vivax* Merozoite Surface Protein-1 and the TLR-5 Agonist *Salmonella typhimurium* FliC Flagellin," *Vaccine*, 26(48): 6132-6142 (Sep. 2008).
Barton, G. M. and Medzhitov, R., "Control of Adaptive Immune Responses by Toll-like Receptors," *Curr. Opin. Immunol.*, 14(3):380-383 (2002).
Beatson, S. A., et al., "Variation in Bacterial Flagellins: From Sequence to Structure," *Trends Microbiology*, 14(4):151-155 (Apr. 2006).
Bendelac, A. and Medzhitov, R., "Adjuvants of Immunity: Harnessing Innate Immunity to Promote Adaptive Immunity," *J. Exp. Med.*, 195(5):F19-F23 (Mar. 2002).
Ben-Yedidia, T. and Arnon, R., "Towards an Epitope-Based Human Vaccine for Influenza," *Human Vaccines*, 1(3):95-101 (2005).
Ben-Yedidia, T., et al., "Intranasal Administration of Peptide Vaccine Protects Human/Mouse Radiation Chimera from Influenza Infection," *International Immunology*, 11(7):1043-1051 (1999).
Ben-Yedidia, T., et al., "Intranasal Administration of Synthetic Recombinant Peptide-Based Vaccine Protects Mice from Infection by *Schistosoma mansoni*," *Infect. Immun.*, 67(9):4360-4366 (Sep. 1999).
Bianchi, E., et al.,"Universal Influenza B Vaccine Based on the Maturational Cleavage Site of the Hemagglutinin Precursor," *J. Virology*, 79(12):7380-7388 (2005).
Blander, J. M. and Medzhitov, R., "Toll-Dependent Selection of Microbial Antigens for Presentation by Dendritic Cells," *Nature*, 440(7085):808-812 (Apr. 2006).
Bright, R. A., et al., "Impact of Glycosylation and Immunogenicity of DNA-based Influenza H5 HA Vaccine," *Virology*, 308:270-278 (2003).
Chen, H., et al., "Avian Flu: H5N1 Virus Outbreak in Migratory Waterfowl," *Nature*, 436(7048):191-192 (Jul. 2005).
Cuadros, C., et al., "Flagellin Fusion Proteins as Adjuvants or Vaccines Induce Specific Immune Responses," *Infect. Immun.*, 72(5):2810-2816 (May 2004).
das Graças Luna, M., et al., "*Salmonella* Flagellin Fused with a Linear Epitope of Colonization Factor Antigen I (CFA/I) Can Prime Antibody Responses Against Homologous and Heterologous Fimbriae of Enterotoxigenic *Escherichia coli*," *Res. Microbiol.*, 151(7):575-582 (2000).
Database GenBank [Online] May 17, 2013, "Phase 1 flagellin [*Salmonella enterica*]," Database Accession No. AAR10645.1, Sequence updated May 7, 2004.
Database UniProt [Online] Aug. 23, 2011, "Phase 2 flagellin [*Salmonella choleraesuis*]," Database Accession No. Q6V357, Sequence updated Jul. 5, 2004.
de Vries, N., et al., "Production of Monoclonal Antibodies Specific for the *i* and *1,2* Flagellar Antigens of *Salmonella typhimurium* and Characterization of Their Respective Epitopes," *Appl. Environ. Microbiol.*, 64(12):5033-5038 (Dec. 1998).

(56) References Cited

OTHER PUBLICATIONS

Donnelly, M. A., et al., "Two Nonadjacent Regions in Enteroaggregative *Escherichia coli* Flagellin Are Required for Activation of Toll-like Receptor 5," *J. Biol. Chem.*, 277(43):40456-40461 (Oct. 2002).
Eaves-Pyles, T., et al., "Flagellin, a Novel Mediator of *Salmonella*-Induced Epithelial Activation and Systematic Inflammation: IκBα Degradation, Induction of Nitric Oxide Synthase, Induction of Proinflammatory Mediators, and Cardiovascular Dysfunction," *J. Immunol.*, 166(2):1248-1260 (Jan. 2001).
Eaves-Pyles, T. D., et al., "*Salmonella* Flagellin-Dependent Proinflammatory Responses Are Localized to the Conserved Amino and Carboxyl Regions of the Protein," *J. Immunol.*, 167(12):7009-7016 (Dec. 2001).
Fiers, W., et al., "A "Universal" Human Influenza A Vaccine," *Virus Research*, 103:173-176 (2004).
Gasparini, R., et al., "Purification of Influenza B Virus Hemagglutinin by Isoelectric Focusing," *J. Preventive Med. Hygiene*, 45:17-20 (2004).
Gewirtz, A. T., et al., "*Salmonella typhimurium* Translocates Flagellin Across Intestinal Epithelia, Inducing a Proinflammatory Response," *J. Clin. Invest.*, 107(1):99-109 (Jan. 2001).
Gugolya, Z., et al., "Interaction of the Disordered Terminal Regions of Flagellin Upon Flagellar Filament Formation," *FEBS Lett.*, 535:66-70 (2003).
Hayashi, F., et al., "The Innate Immune Response to Bacterial Flagellin is Mediated by Toll-Like Receptor 5," *Nature*, 410(6832):1099-1103 (Apr. 2001).
Honko, A. N. and Mizel, S. B., "Mucosal Administration of Flagellin Induces Innate Immunity in the Mouse Lung," *Infect. Immun.*, 72(11):6676-6679 (Nov. 2004).
Horváth, A., et al., "A Hemagglutinin-based Multipeptide Construct Elicits Enhanced Protective Immune Response in Mice Against Influenza A Virus Infection," *Immunol. Lett.*, 60:127-136 (1998).
Huleatt, J. W., et al., "Vaccination with Recombinant Fusion Proteins Incorporating Toll-Like Receptor Ligands Induces Rapid Cellular and Humoral Immunity," *Vaccine*, 25(4):763-775 (2007).
Huleatt, J. W., et al., "Potent Immunogenicity and Efficacy of a Universal Influenza Vaccine Candidate Comprising a Recombinant Fusion Protein Linking Influenza M2e to the TLR5 Ligand Flagellin," *Vaccine*, 26(2):201-214 (2008).
Ibrahim, G. F., et al., "Method for the Isolation of Highly Purified *Salmonella* Flagellins," *J. Clin. Microbiol.*, 22(6):1040-1044 (Dec. 1985).
Jegerlehner, A., et al., "Influenza A Vaccine Based on the Extracellular Domain of M2: Weak Protection Mediated via Antibody-Dependent NK Cell Activity," *J. Immunol.*, 172:5598-5605 (May 2004).
Jeon, S. H. and Arnon, R., "Immunization with Influenza Virus Hemagglutinin Globular Region Containing the Receptor-Binding Pocket," *Viral Immunol.*, 15(1):165-176 (2002).
Jeon, S. H., et al., "Intranasal Immunization with Synthetic Recombinant Vaccine Containing Multiple Epitopes of Influenza Virus," *Vaccine*, 20:2772-2780 (2002).
Kopp, E. B. and Medzhitov, R., "The Toll-Receptor Family and Control of Innate Immunity," *Current Opinion in Immunology*, 11:13-18 (1999).
Lamb, R. A., et al., "Influenza Virus M2 Protein is an Integral Membrane Protein Expressed on the Infected-cell Surface," *Cell*, 40:627-633 (Mar. 1985).
Levi, R. and Arnon, R., "Synthetic Recombinant Influenza Vaccine Induces Efficient Long-Term Immunity and Cross-Strain Protection," *Vaccine*, 14(1):85-92 (1996).
Liu, G., et al., "Immunogenicity and Efficacy of Flagellin-fused Vaccine Candidates Targeting 2009 Pandemic H1N1 Influenza in Mice," *PLoS ONE*, 6(6): e20928 (2011).
Liu, J., et al., "Highly Pathogenic H5N1 Influenza Virus Infection in Migratory Birds," *Science*, 309(5738):1206 (Aug. 2005).
Liu, W., et al., "Monoclonal Antibodies Recognizing EVETPIRN Epitope of Influenza A Virus M2 Protein Could Protect Mice from Lethal Influenza A Virus Challenge," *Immunol. Lett.*, 93:131-136 (2004).
McDonald, W. F., et al., "A West Nile Virus Recombinant Protein Vaccine that Coactivates Innate and Adaptive Immunity," *J. Infect. Dis.*, 195(11):1607-1617 (Jun. 2007).
McEwen, J., et al., "Synthetic Recombinant Vaccine Expressing Influenza Haemagglutinin Epitope in *Salmonella* Flagellin Leads to Partial Protection in Mice," *Vaccine*, 10(6): 405-411 (1992).
McQuiston, J. R., et al., "Sequencing and Comparative Analysis of Flagellin Genes *fliC*, *fljB*, and *flpA* from *Salmonella*," *J. Clinical Microbiol.*, 42(5):1923-1932 (May 2004).
McSorley, S. J., et al., "Bacterial Flagellin is an Effective Adjuvant for CD4$^+$ T Cells in Vivo," *J. Immunol.*, 169:3914-3919 (2002).
Means, T. K., et al., "The Toll-Like Receptor 5 Stimulus Bacterial Flagellin Induces Maturation and Chemokine Production in Human Dendritic Cells," *J. Immunol.*, 170:5165-5175 (2003).
Medzhitov, R., "Toll-Like Receptors and Innate Immunity," *Nature Reviews Immunology*, 1:135-145 (Nov. 2001).
Medzhitov, R., and Janeway, C. A., Jr., "Innate Immunity: The Virtues of a Nonclonal System of Recognition," *Cell*, 91:295-298 (Oct. 1997).
Medzhitov, R., and Janeway, C. A., Jr., "Innate Immunity: Impact on the Adaptive Immune Response," *Current Opinion in Immunology*, 9(1):4-9 (1997).
Medzhitov, R., and Janeway, C. A., Jr., "Self-Defense: The Fruit Fly Style," *Proc. Natl. Acad. Sci. USA*, 95(2):429-430 (Jan. 1998).
Medzhitov, R., and Janeway, C. A., Jr., "Innate Immune Recognition and Control of Adaptive Immune Responses," *Sem. Immunol.*, 10:351-353 (1998).
Medzhitov, R., and Janeway, C. A., Jr., "An Ancient System of Host Defense," *Current Opinion in Immunology*, 10:12-15 (1998).
Medzhitov, R., and Janeway, C., Jr., "Innate Immune Recognition: Mechanisms and Pathways," *Immunological Reviews*, 173:89-97 (2000).
Medzhitov, R., and Janeway, C., Jr., "Innate Immunity," *New England Journal of Medicine*, 343:338-344 (Aug. 2000).
Medzhitov, R., and Janeway, C. A., Jr., "How Does the Immune System Distinguish Self from Nonself?" *Sem. Immunol.*, 12:185-188 (2000).
Medzhitov, R., and Janeway, C., Jr., "The Toll Receptor Family and Microbial Recognition," *Trends Microbiol.*, 8(10):452-456 (Oct. 2000).
Medzhitov, R., et al., "A Human Homologue of the *Drosophila* Toll Protein Signals Activation of Adaptive Immunity," *Nature*, 388(6640):394-397 (Jul. 1997).
Michen B. and Graule, T., "Isoelectric Points of Viruses," *J. Applied Microbiol.*, 109:388-397 (2010).
Mizel, S. B., et al., "Flagellin-F1-V Fusion Protein Is an Effective Plague Vaccine in Mice and Two Species of Nonhuman Primates," *Clinical and Vaccine Immunology*, 16(1):21-28 (Jan. 2009).
Mozdzanowska, K., et al., "Induction of Influenza Type A Virus-Specific Resistance by Immunization of Mice with a Synthetic Multiple Antigenic Peptide Vaccine that Contains Ectodomains of Matrix Protein 2," *Vaccine*, 21:2616-2626 (Jun. 2003).
Murthy, K. G. K., et al., "Identification of Conserved Domains in *Salmonella muenchen* Flagellin That Are Essential for Its Ability to Activate TLR5 and to Induce an Inflammatory Response in Vitro," *J. Biol. Chem.*, 279(7):5667-5675 (2004).
Murthy, K. G. K., et al., "Identification of Protein Motifs and the Role of Particular Amino Acids in Biological Activity of Flagellin as an Inducer of Proinflammatory Responses in Human Cells," *FASEB Journal*, 17(4-5): A965, Abstract 601.2 (2003).
Nagy, Z., et al., "The Intersubunit Region of the Influenza Virus Haemagglutinin is Recognized by Antibodies During Infection," *Scand. J. Immunol.*, 40:281-291 (1994).
Nayak, D. P., et al., "Biological and Immunological Properties of Haemagglutinin and Neuraminidase Expressed from Cloned cDNAs in Prokaryotic and Eukaryotic cells," *Vaccine*, 3(Suppl.):165-171 (1985).
Neirynck, S., et al., "A Universal Influenza A Vaccine Based on the Extracellular Domain of the M2 Protein," *Nature Medicine*, 5(10):1157-1163 (Oct. 1999).
Newton, S. M. C., et al., "Immune Response to Cholera Toxin Epitope Inserted in *Salmonella* Flagellin," *Science*, 244(4900):70-72 (Apr. 1989).

(56) References Cited

OTHER PUBLICATIONS

O'Hagan, D. T., et al., "Recent Developments in Adjuvants for Vaccines Against Infectious Diseases," *Biomol. Eng.*, 18:69-85 (2001).
Pasare, C. and Medzhitov, R., "Toll-like Receptors and Acquired Immunity," *Sem. Immunol.*, 16(1):23-26 (2004).
Petrenko, V. A., et al., "Cloning and Expression in *Escherichia coli* of the Hemagglutinin Gene of Influenza Virus Subtype H1," *Molecular Biology (Mosk.)*, 23(3, Part 2):704-712 (1989).
Petrenko, V. A., et al., "Construction of a Gene of Hybrid Influenza Virus Hemagglutinin Subtype H1-H3 and Its Expression in *Escherichia coli*," *Molecular Biology (Mosk.)*, 24(2, Part 1):331-339 (1990).
Powers, D. C., et al., "Influenza A Virus Vaccines Containing Purified Recombinant H3 Hemagglutinin are Well Tolerated and Induce Protective Immune Responses in Healthy Adults," *J. Infect. Dis.*, 171:1595-1599 (1995).
Rock, F. L., et al., "A Family of Human Receptors Structurally Related to Drosophila Toll," *Proc. Natl. Acad. Sci USA*, 95(2):588-593 (Jan. 1998).
Sadoff, J. C., et al., "Oral *Salmonella typhimurium* Vaccine Expressing Circumsporozoite Protein Protects Against Malaria," *Science*, 240(4850): 336-338 (Apr. 1988).
Saelens, X., et al., "Protection of Mice against a Lethal Influenza Virus Challenge after Immunization with Yeast-derived Secreted Influenza Virus Hemagglutinin," *Eur. J. Biochem.*, 260:166-175 (1999).
Schnare, M., et al., "Toll-Like Receptors Control Activation of Adaptive Immune Responses," *Nature Immunology*, 2(10):947-950 (Oct. 2001).
Smith, K. D., et al., "Toll-like Receptor 5 Recognizes a Conserved Site on Flagellin Required for Protofilament Formation and Bacterial Motility," *Nat. Immunology*, 4(12):1247-1253 (Dec. 2003).
Song, L., et al., "Efficacious Recombinant Influenza Vaccines Produced by High Yield Bacterial Expression: A Solution to Global Pandemic and Seasonal Needs," *PLoS ONE*, 3(5): e2257 (May 2008).
Stocker, B. A. D., et al., "Immune Responses to Epitopes Inserted in *Salmonella* Flagellin," *Intern. Rev. Immunol.*, 11:167-178 (1994).
Sztein, M. B., et al., "Cytokine Production Patterns and Lymphoproliferative Responses in Volunteers Orally Immunized with Attenuated Vaccine Strains of *Salmonella typhi*," *J. Infect. Dis.*, 170(6):1508-1517 (1994).
Torok, A. M., et al., "*Helicobacter pylori* Induces Interleukin-8 Secretion by Toll-Like Receptor 2- and Toll-Like Receptor 5-Dependent and -Independent Pathways," *Infect. Immun.*, 73(3):1523-1531 (Mar. 2005).
Treanor, J. J., et al., "Passively Transferred Monoclonal Antibody to the M2 Protein Inhibits Influenza A Virus Replication in Mice," *J. Virology*, 64(3):1375-1377 (Mar. 1990).
Treanor, J. J., et al., "Safety and Immunogenicity of a Recombinant Hemagglutinin Vaccine for H5 Influenza in Humans," *Vaccine*, 19:1732-1737 (2001).
Treanor, J. J., et al., "Dose-Related Safety and Immunogenicity of a Trivalent Baculovirus-Expressed Influenza-Virus Hemagglutinin Vaccine in Elderly Adults," *J. Infect. Dis.*, 193:1223-1228 (2006).
Tung, C.-S., et al., "Homology Model of the Structure of Influenza B Virus HA1," *J. General Virology*, 85:3249-3259 (2004).
Ulrich, R., et al., "Core Particles of Hepatitis B Virus as Carrier for Foreign Epitopes," In *Advances in Virus Research*, Maramorosch, K., et al., eds. (Academic Press), vol. 50, pp. 141-182 (1998).
van Duin, D., et al., "Triggering TLR Signaling in Vaccination," *Trends Immunology*, 27(1):49-55 (Jan. 2006).
Verma, N. K., et al., "Delivery of Class I and Class II MHC-Restricted T-Cell Epitopes of Listeriolysin of *Listeria monocytogenes* by Attenuated *Salmonella*," *Vaccine*, 13(2):142-150 (1995).
Weimer, E. T., et al. "A Fusion Protein Vaccine Containing OprF Epitope 8, OprI, and Type A and B Flagellins Promotes Enhanced Clearance of Nonmucoid *Pseudomonas aeruginosa*," *Infect. Immun.*, 77(6):2356-2366 (Jun. 2009).
Weimer, E. T., et al , "Immunization of Young African Green Monkeys with OprF Epitope 8-OprI-Type A- and B-Flagellin Fusion Proteins Promotes the Production of Protective Antibodies Against Nonmucoid *Pseudomonas aeruginosa*," *Vaccine*, doi:10.1016/j.vaccine.2009.08.080:1-8, (2009).
Westerlund-Wikström, B., et al., "Functional Expression of Adhesive Peptides as Fusions to *Escherichia coli* Flagellin," *Protein Engineering*, 10(11):1319-1326 (1997).
Westerlund-Wilkström, B., "Peptide Display on Bacterial Flagella: Principles and Applications," *Int. J. Med. Microbiol.*, 290(3):223-230 (2000).
Wu, J. Y., et al., "Expression of Immunogenic Epitopes of Hepatitis B Surface Antigen with Hybrid Flagellin Proteins by a Vaccine Strain of *Salmonella*," *Proc. Natl. Acad. Sci. USA*, 86(12):4726-4730 (Jun. 1989).
Wyant, T. L., et al., "Potent Immunoregulatory Effects of *Salmonella typhi* Flagella on Antigenic Stimulation of Human Peripheral Blood Mononuclear Cells," *Infect. Immun.*, 67(3):1338-1346 (Mar. 1999).
Wyant, T. L., et al., "*Salmonella typhi* Flagella are Potent Inducers of Proinflammatory Cytokine Secretion by Human Monocytes," *Infect. Immun.*, 67(7):3619-3624 (Jul. 1999).
Yinghua, L., "Progress in the Study of the Flagellins from *Salmonella*," *Foreign Medical Science (Volume Microbiology)*, 5:24-26 (2002).
Yoon, S., et al., "Structural Basis of TLR5-Flagellin Recognition and Signaling," *Science*, 335:859-864 (2012).
Yoshioka, K., et al., "Flagellar Filament Structure and Cell Motility of *Salmonella typhimurium* Mutants Lacking Part of the Outer Domain of Flagellin," *J. Bacteriol.*, 177(4):1090-1093 (Feb. 1995).
Zeitlin, G. A. and Maslow, M. J., "Avian Influenza," *Curr. Infect. Dis. Rep.*, 7:193-199 (2005).
Zhang, X.-L., et al., "*Salmonella typhi*: From a Human Pathogen to a Vaccine Vector," *Cell. Mol. Immunol.*, 5(2):91-97 (Apr. 2008).
Arias, Mauricio A., et al., "Carnauba wax nanoparticles enhance strong systemic and mucosal cellular and humoral immune responses to HIV-gp 140 antigen," Vaccine 29(6): 1258-1269 (2010).
Bommakanti, G., et al., "Design of an HA2-based *Escherichia coli* expressed influenza immunogen that protects mice from pathogenic challenge," PNAS 107:31 13701-13706 (2010).
Davis, A.R., et al., "Immune response to human influenza virus hemagglutinin expressed in *Escherichia coli*" Gene 21:273-284 (1983).
Nempont, C., et al., "Deletion of Flagellin's Hypervariable Region Abrogates Antibody-Mediated Neutralization and Systemic Activation of TLR5-Dependent Immunity," Journal of Immunology 181(3):2036-2043 (2008).
Nwe, N., et al., "Expression of hemagglutinin protein from the avian influenza virus H5N1 in a baculovirus/insect cell system significantly enhanced by suspension culture," *BMC Microbiology* 6(16) 1-7 (2006).
Singh, M., et al., "Cationic Microparticles Are an Effective Delivery System for Immune Stimulatory CpG DNA," Pharmaceutical Research 18(10): 1476-1479 (2001).
Singh, M., et al., "Polylactide-Co-Glycolide Microparticles with Surface Adsorbed Antigens as Vaccine Delivery Systems," Current Drug Delivery 3(1): 115-120 (2006).
Talbot, H.K., et al., "Immunopotentiation of Trivalent Influenza Vaccine When Given with VAX102, a Recombinant Influenza M2e Vaccine Fused to the TLR5 Ligand Flagellin," PLOS ONE 5(12): e14442 (2010).
Tonegawa, K., et al., "Analysis of epitope recognition of antibodies induced by DNA immunization against hemagglutinin protein of influenza A virus," *Vaccine* 21:3118-3125 (2003).
Wang, B.-Z., et al., "Enhanced influenza Virus-Like Particle Vaccines Containing the Extracellular Domain of Matrix Protein 2 and a Toll-Like Receptor Ligand," *Clinical and Vaccine Immunology*, 19(8): 1119-1125 (2012).
Ye, Ling, et al., "Antigenic properties of a transport-competent influenza HA/HIV Env chimeric protein," *Virology* 352:74-85 (2006).
Zhang, W., et al., "Construction of Eukaryotic Expressing Plasmids Encoding *HA* and *HA1* of Influenza A Virus and Their Transient Expression in HK293 Cells," *Journal of Huazhong University of Science and Technology* 26(2):225-227 (2006).

\* cited by examiner

FIG. 12

$M_1$AQVINTNSLSLLTQNNLNKSQSALGTAIERLSSGLRINSAKDDAA$_{46}$G$_{47}$QAIANRFTANIKGLT
QASRNANDGISIAQTTEGALNEINNLQRVRELAVQSANS$_{102}$(D1l-
o1)T$_{103}$NSQSDLDSIQAEITQRLNEIDRVSGQTQFNGVKVLAQDNTLTIQVGANDGETIDIDLK
QINSQTLGLDSLNVQ$_{176}$K$_{177}$A$_{178}$(D2l-o2)Y$_{179}$DVKDTAVT$_{187}$(D2l-
o1)T$_{188}$KA$_{190}$Y$_{191}$ANNGTTLDVSGLDDAAIKAATGGTNGTASVTGGAVKFDA$_{230}$(D3l-
o2)D$_{231}$NNKYFVTIGGFTG$_{244}$(D3l-s1)A$_{245}$DAAKNGDYEVNVAT$_{259}$(D3l-
i1)D$_{260}$GTVLAAGATKTTMPAG$_{277}$(D3l-
o1)A$_{278}$TTKTEVQELKDTP$_{291}$A$_{292}$VVSADAKNALIAGGVD$_{308}$(D2l-
c1)A$_{309}$TDANGAELVKMSYTDKN$_{326}$(D2l-o3)
G$_{327}$KTIEGGYALKAGDKYYAADYDEATGAIKAKTTSYTAADG$_{366}$(D2l-
i1)T$_{367}$TKTAANQLGGVDGKTEVVTID$_{388}$(D2l-
i2)G$_{389}$KTYNASKAAGHDFKAQPELAEAAAK$_{414}$T$_{415}$TENPLQKIDAALAQVDALRSDLGAVQN
RFNSAITNLGNTVNNLSEARSR$_{464}$l$_{465}$EDSDYATEVSNMSRAQILQQAGTSVLAQANQVPQNV
LSLLR$_{506}$

Domain 0: 1-46 + 465-506; Domain 1, 47-176 + 415-464; Domain 2, 177-190 + 292-414; Domain 3, 191-291. The amino acid number of both domain boundaries and insertion points are labeled.

FIG. 30

FUSION PROTEINS AND METHODS OF USE

RELATED APPLICATION

This application claims the benefit of U.S. Provisional Application No. 61/743,165, filed on Aug. 28, 2012. The entire teachings of the above application are incorporated herein by reference.

INCORPORATION BY REFERENCE OF MATERIAL IN ASCII TEXT FILE

This application incorporates by reference the Substitute Sequence Listing contained in the following ASCII text file:
a) File name: 37101054001SUBSTITUTESE-QUENCELISTING.txt; created Sept. 13, 2013, 1,174 KB in size.

GOVERNMENT SUPPORT

This invention was made with government support under HHS01002011000011C from the Biomedical Advanced Research and Development Authority. The government has certain rights in the invention.

BACKGROUND OF THE INVENTION

Compositions that include antigens can be employed to stimulate immunity to disease consequent to or infection from exposure to an organism that includes the antigen. Antigens employed in compositions to stimulate immunity, specifically protective immunity to a particular disease, often resemble the disease-causing organism from which the antigen is a source. Compositions that include antigens may also include adjuvants that augment the immune response to the antigen to maximize the production of antibodies that neutralize the related antigen in a disease-causing organism. Recombinant DNA technology has been employed to generate fusion proteins that include antigens and Toll-like Receptor agonists, specifically, flagellin, which is a Toll-like Receptor δ agonist, to augment an immune response to the antigen. However, not all antigens are suitable for existing formats of fusion proteins to flagellin. Therefore, a need exists for new and improved designs of fusion protein that include flagellin and an antigen for use in methods of stimulating an immune response, specifically a protective immune response to the antigen.

SUMMARY OF THE INVENTION

The present invention generally relates to compositions that include fusion proteins that stimulate an immune response, specifically a protective immune response in a subject, and methods of using the fusion proteins.

In an embodiment, the invention is a composition that includes a fusion protein comprising a flagellin and at least one antigen that has an isoelectric point greater than about 7.0 and is fused to at least one loop of domain 3 of the flagellin. The fusion protein of the invention activates a Toll-like Receptor 5.

In another embodiment, the invention is a composition that includes a fusion protein comprising a flagellin and at least one antigen that has an isoelectric point greater than about 7.5 and is fused to at least one loop of domain 3 of the flagellin. The fusion protein of the invention activates a Toll-like Receptor 5.

In another embodiment, the invention is a composition comprising at least three fusion proteins that each activate a Toll-like Receptor 5, wherein: (a) a first fusion protein includes a first flagellin and a first influenza A viral hemagglutinin antigen that has an isoelectric point greater than about 6.0 fused to a portion of the first flagellin; (b) a second fusion protein includes a second flagellin and a second influenza A viral hemagglutinin antigen that is distinct from the first influenza A viral hemagglutinin antigen and that has an isoelectric point greater than about 7.0 fused to a portion of the second flagellin; and (c) a third fusion protein includes a third flagellin and a first influenza B viral hemagglutinin antigen that has an isoelectric point greater than about 8.0 and is fused to at least one loop of domain 3 of the third flagellin.

In yet another embodiment, the invention is a composition comprising at least four fusion proteins that each activate a Toll-like Receptor 5, wherein: (a) a first fusion protein includes a first flagellin and a first influenza A viral hemagglutinin antigen that has an isoelectric point greater than about 6.0 fused to a portion of the first flagellin; (b) a second fusion protein includes a second flagellin and a second influenza A viral hemagglutinin antigen that is distinct from the first influenza A viral hemagglutinin antigen and that has an isoelectric point greater than about 7.0 fused to a portion of the second flagellin; (c) a third fusion protein includes a third flagellin and a first influenza B viral hemagglutinin antigen that has an isoelectric point greater than about 8.0 and is fused to at least one loop of domain 3 of the third flagellin; and (d) a fourth fusion protein that activates a Toll-like Receptor 5 includes a second influenza B viral hemagglutinin antigen that is distinct from the first influenza B viral hemagglutinin antigen and that has an isoelectric point greater than about 8.0 fused to at least one loop of domain 3 in the fourth flagellin.

In another embodiment, the invention is a method of stimulating an immune response to an antigen in a subject, comprising the step of administering to the subject a composition that includes a fusion protein that activates a Toll-like Receptor 5, the fusion protein comprising a flagellin and at least one antigen that has an isoelectric point greater than about 7.0 and that is fused to at least one loop of domain 3 of the flagellin.

In still another embodiment, the invention is a method of stimulating an immune response to an antigen in a subject, comprising the step of administering to the subject a composition that includes a fusion protein that activates a Toll-like Receptor 5, the fusion protein comprising a flagellin and at least one antigen that has an isoelectric point greater than about 7.5 and that is fused to at least one loop of domain 3 of the flagellin.

In yet another embodiment, the invention is a method of stimulating an immune response in a subject, comprising the step of administering to the subject a composition that includes at least three fusion proteins each of which activates a Toll-like Receptor 5, wherein: (a) a first fusion protein includes a first flagellin and a first influenza A viral hemagglutinin antigen that has an isoelectric point greater than about 6.0 fused to a portion of the first flagellin; (b) a second fusion protein includes a second flagellin and a second influenza A viral hemagglutinin antigen that is distinct from the first influenza A viral hemagglutinin antigen and that has an isoelectric point greater than about 7.0 fused to a portion of the second flagellin; and (c) a third fusion protein includes a third flagellin and a first influenza B viral hemagglutinin antigen that has an isoelectric point greater than about 8.0 and is fused to at least one loop of domain 3 of the third flagellin.

In still another embodiment, the invention is a method of stimulating an immune response in a subject, comprising the step of administering to the subject a composition that includes at least four fusion proteins each of which activates a Toll-like Receptor 5, wherein: (a) a first fusion protein includes a first flagellin and a first influenza A viral hemagglutinin antigen that has an isoelectric point greater than about 6.0 fused to a portion of the first flagellin; (b) a second fusion protein includes a second flagellin and a second influenza A viral hemagglutinin antigen that is distinct from the first influenza A viral hemagglutinin antigen and that has an isoelectric point greater than about 7.0 fused to a portion of the second flagellin; (c) a third fusion protein includes a third flagellin and a first influenza B viral hemagglutinin antigen that has an isoelectric point greater than about 8.0 and is fused to at least one loop of domain 3 of the third flagellin; and (d) a fourth fusion protein that activates a Toll-like Receptor 5 includes a second influenza B viral hemagglutinin antigen that is distinct from the first influenza B viral hemagglutinin antigen and that has an isoelectric point greater than about 8.0 fused to at least one loop of domain 3 in the fourth flagellin.

The compositions and methods of the invention can be employed to stimulate an immune response, in particular, a protective immune response in the subject. Advantages of the claimed invention include, for example, the production of fusion proteins that have antigens with isoelectric points greater than about 7.0 that stimulate an adaptive immune response to the antigen sufficient to generate antibodies that provide protective immunity to a disease-causing organism that includes the antigen. The compositions of the invention provide an appropriate balance of innate and adaptive immune stimulating properties for use in vaccines that include antigens having an isoelectric point greater than about 7.0.

FIG. 11 shows relative immunogenicity of B/Wisconsin/1/2010 formats: R3 B/WI (●, HL719, SEQ ID NO: 154, R3 with negative linker), R3 B/WI (■, HL724, SEQ ID NO: 152, R3 construct format with additional negative charges in the amino acid extension), D3Ins B WI (▲, HL772, SEQ ID NO: 126 or F147 buffer (●). Data are shown as titers of individual mice with GMTs. Statistical differences were determined in 1-way ANOVA/Tukey test. *, $p<0.05$, ***, $p<0.001$.

FIG. 12 shows HAI titers of monovalent flu B (influenza B) compositions: R3 formats (HL611, SEQ ID NO: 150; HL753, SEQ ID NO: 155; HL742, SEQ ID NO: 156) or D3Ins format compositions of B/Brisbane/60/08-like viruses (B/Brisbane/60/08 or B/BR, HL657, SEQ ID NO: 128; B/Hong Hong/259/10 or B/HK, HL774, SEQ ID NO: 157; and B/Bangladesh/5945/09 or B/BD, HL787, SEQ ID NO: 158). Controls included FLUVIRIN® or F147 buffer. Data are shown as titers of individual mice with GMTs. Statistical differences were determined in 2-way ANOVA/Tukey tests, *, $p<0.05$, **, $p<0.01$.

FIGS. 13A and 13B show in vivo TLR5 stimulated cytokine production:

Comparison of variations of D3Ins format fusion proteins: B Wisconsin (Yamagata lineage) D3I-o1 (HL772, SEQ ID NO: 126), D3I-s1 (HL848, SEQ ID NO: 160), and D3I-i1 (HL849, SEQ ID NO: 159). R3.HA1 (HL185, SEQ ID NO: 143) was included as a positive control.

FIG. 14 depicts the structure of flagellin, domains 0, 1, 2 and 3 and insertion sites in flagellin (SEQ ID NO: 2) for generation of fusion proteins that include antigens. Reference to amino acid numbers are made to SEQ ID NO: 2.

FIGS. 15A and 15B show the in vivo TLR5 stimulated cytokine production: Comparison of variations of D3I and D2I fusion protein constructs: B Wisconsin (Yamagata lineage) D3I-o1 (HL772, SEQ ID NO: 126), D2I-o1 (HL825, SEQ ID NO: 161), D2I-o2 (HL826, SEQ ID NO: 162), D2I-o3 (HL827, SEQ ID NO: 163), D1I-o1 (HL828, SEQ ID NO: 164) and D2I-i1 (HL850, SEQ ID NO: 165) and B Brisbane (Victoria lineage) D3I-o1 (HL657, SEQ ID NO: 128), D2I-o1 (HL733, SEQ ID NO: 166), D2I-o1 (HL856, SEQ ID NO: 167) and D2I-o2 (HL857, SEQ ID NO: 168). R3.HA1 (HL185, SEQ ID NO: 143) was included as a positive control. IL-6 (FIG. 15 A) and TNF-alpha (FIG. 15B) levels of individual mice are shown, along with bars representing the mean and standard error.

FIGS. 16A and 16B show in vivo TLR5 stimulated cytokine production: Comparison of variations of D3I and D2I fusion protein constructs: B Wisconsin (Yamagata lineage) were compared in FIG. 16A: D3I-o1 (HL772, SEQ ID NO: 126), D3I-o2 (HL888, SEQ ID NO: 169), D2I-c1 (HL890, SEQ ID NO: 170), D2I-i2 (HL892, SEQ ID NO: 171) and B Brisbane (Victoria lineage) were compared in FIG. 16B: D3I-o1 (HL657, SEQ ID NO: 128), D2I-o3 (HL858, SEQ ID NO: 172), D3I-s1 (HL860, SEQ ID NO: 173), D3I-o2 (HL889, SEQ ID NO: 174), D2I-c1 (HL891, SEQ ID NO: 175) and D2I-i2 (HL893, SEQ ID NO: 176). R3.HA1 (HL185, SEQ ID NO: 143) was included as a positive control. The concentrations of IL6 from individual mice are shown, along with bars representing the mean and standard error.

FIG. 17 shows NIA assay for insertion variants (B/Wisconsin/1/2010): D3Ins (○, HL772, D3I-o1, SEQ ID NO: 126), various D2Ins (Δ, HL825, D2I-o1, SEQ ID NO: 161; ◇, HL826, D2I-o2, SEQ ID NO: 162; ●, HL827, D2I-o3, SEQ ID NO: 163), and D1Ins (■, HL828, D1I-o1, SEQ ID NO: 164), in comparison to R3 format (▲, HL724, SEQ ID NO: 152).

FIGS. 18A and 18B show NIA assay for B/Wisconsin/1/2010 D2I variants in comparison to D3I format. A) B/Wisconsin/1/2010 D3I insertion fusion proteins: D3I-o1 (○, HL772, SEQ ID NO: 126), D3I-s1 (Δ, HL848, SEQ ID NO: 160), D3I-i1 (◇, HL849, SEQ ID NO: 159), and D3I (▲, HL864, SEQ ID NO: 177) in comparison to the D2I-i1 (●, HL850, SEQ ID NO: 165) and D2I (■, HL854, SEQ ID NO: 179) fusion proteins. B) B/Wisconsin/1/2010 D3I insertion fusion proteins: D3I-o1 (○, HL772, SEQ ID NO: 126), D3I-o2 (□, HL888, SEQ ID NO: 169), and D3I-c1 (Δ, HL890, SEQ ID NO: 170), in comparison to D2I-i2 (◇, HL892, SEQ ID NO: 171).

FIG. 19A shows NIA assay data for (B/Brisbane/60/2008) D3I fusion proteins: D3I-o1 (○, HL657, SEQ ID NO: 128) and D3I-i1 (■, HL861, SEQ ID NO: 180), compared to the R3 (□, HL611, SEQ ID NO: 150) fusion protein.

FIG. 19B shows NIA assay for B/Brisbane/60/2008 R3 (□, HL611, SEQ ID NO: 150) fusion protein in comparison to fusion protein insertion variants: D3I-o1 (○, HL657, SEQ ID NO: 128), D2I-o1 (Δ, HL733, SEQ ID NO: 166), D2I-o1 (■, HL856, SEQ ID NO: 167), D2I-o2 (▲, HL857, SEQ ID NO: 168), and D2I-i1 (◆, HL862, SEQ ID NO: 181).

FIG. 20 shows NIA assay for B/Brisbane/60/2008 D3I fusion proteins: D3I-o1 (○, HL657, SEQ ID NO: 128) and D2I-o3 (□, HL858, SEQ ID NO: 172), in comparison to D2I fusion proteins: D3I-s1 (Δ, HL860, SEQ ID NO: 173), D3I-o2 (HL889, SEQ ID NO: 174), D2I-c1 (HL891, SEQ ID NO: 175), D2I-i2 (HL893, SEQ ID NO: 176), and D2I-i1 (HL862, SEQ ID NO: 181).

FIGS. 21A and 21B show HAI studies expressed as GMT in mice to treatment with A) B/Wisconsin/1/2010 (B/WI) fusion protein compositions comprising D3I-o1, HL772, SEQ ID NO: 126; D3I-i1, HL849, SEQ ID NO: 159 and D2I-i1, HL850, SEQ ID NO: 165 or B) B/Sichuan/379/1999 D3I-o1 (HL863, SEQ ID NO: 182) or D3I-i1 (HL903, SEQ ID NO: 183). Positive (HA HU and HA0 WI) and negative F147 (buffer) controls were also included. Seroconversion rates (percentage of mice show a HAI greater than about or equal to 40) are also given. ***, $p<0.001$ vs F147 group in ANOVA test.

FIG. 22 shows HAI titers of mouse sera following treatment with B/Wisconsin/1/2010 (D3Ins B/WI, HL772, SEQ ID NO: 126); B/Hubei-Wujiagang/158/2009 (D3Ins B/HU HL869, SEQ ID NO: 184) and B/Texas/6/2011 (D3Ins B/TX HL871, SEQ ID NO: 185). Horizontal lines represent GMTs (numbers above). Seroconversion rates are shown.

FIG. 23 shows HAI titers elicited by D3Ins fusion protein compositions of B Brisbane or Bangladesh in rabbits. FLUVIRIN® was included as a positive control, and F147 buffer was a negative control. Data are shown as titers of individual rabbits with bars. Horizontal lines represented GMTs (numbers above). Seroconversion percentage is shown.

FIG. 24 shows HAI titers of mouse sera following treatment with fusion protein composition STF2D3InsB/SI (HL863, SEQ ID NO: 182) or formulation buffer (F147). Data were plotted individually with GMTs and seroconversion indicated above.

Figure 25A:
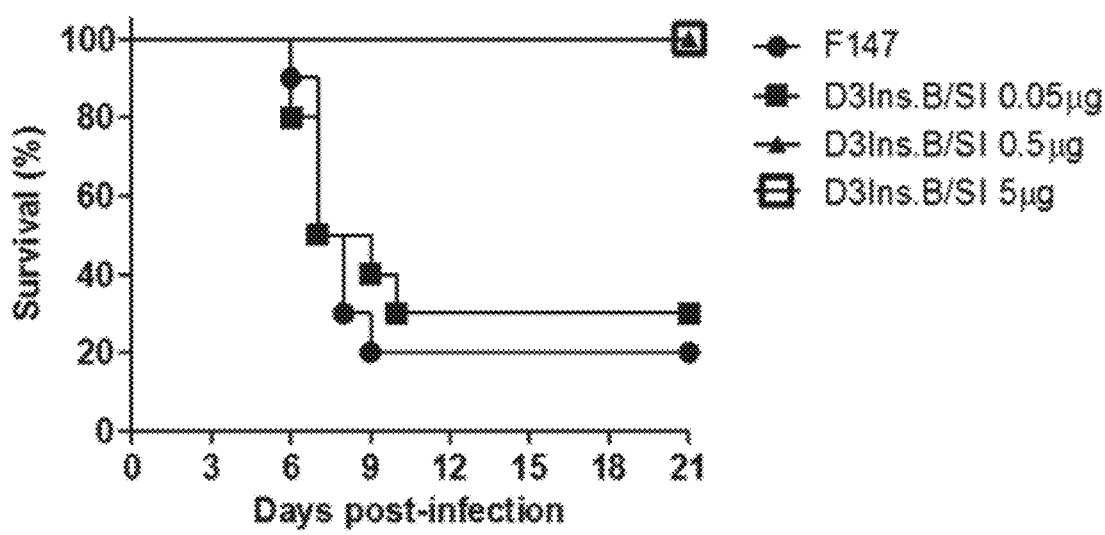
Figure 25B:
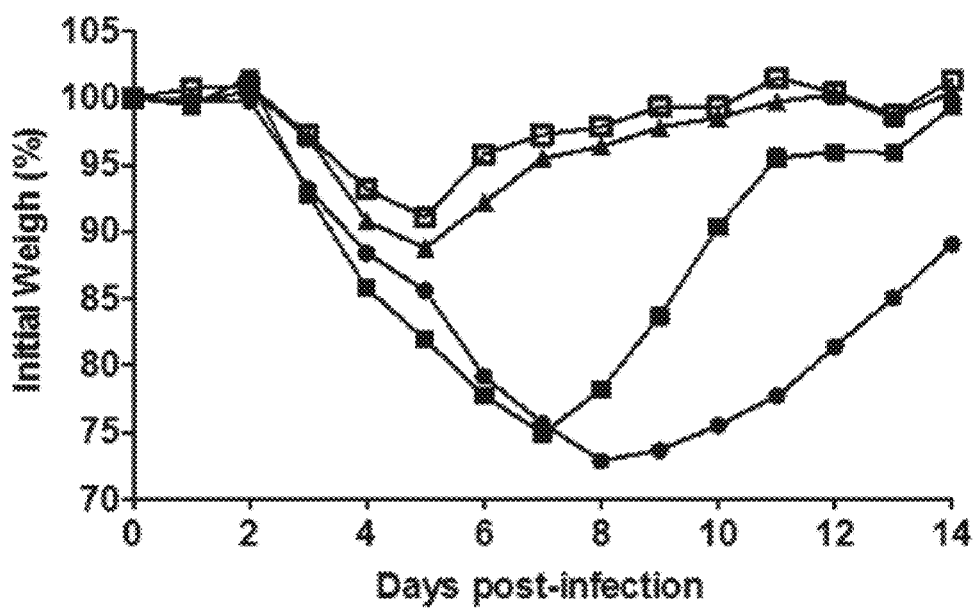

FIGS. 25A and 25B show efficacy of treatment with fusion protein D3Ins B/SI 99 (HL863, SEQ ID NO: 182) compositions in mice challenged with B/Sichuan/379/99 virus. Survival rates (FIG. 25A) and weights (mean percentage of initial weight) (FIG. 25B) are shown.

Figure 26:
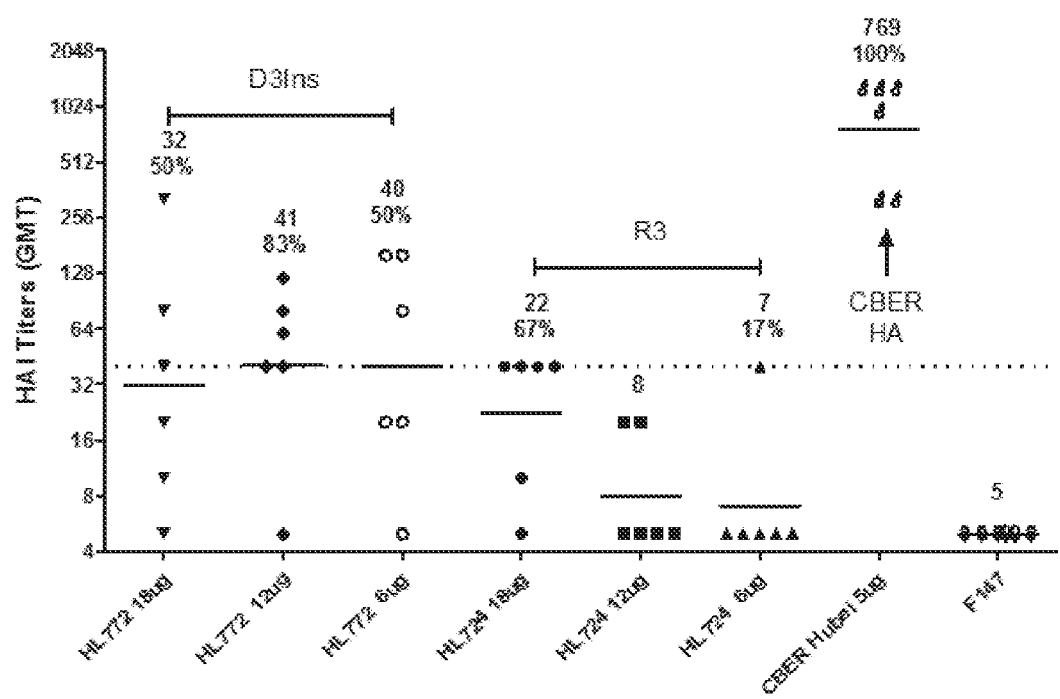

FIG. 26 shows HAI Titers elicited by fusion proteins R3 B Wisconsin (HL724, SEQ ID NO: 152) and D3Ins B Wisconsin (HL772, SEQ ID NO: 126). CBER HA was included as a positive control and F147 buffer was included as a negative control. Data are shown as titers of individual rabbits with bars, and numbers representing geometric means and seroconversion percentages.

Figure 27:
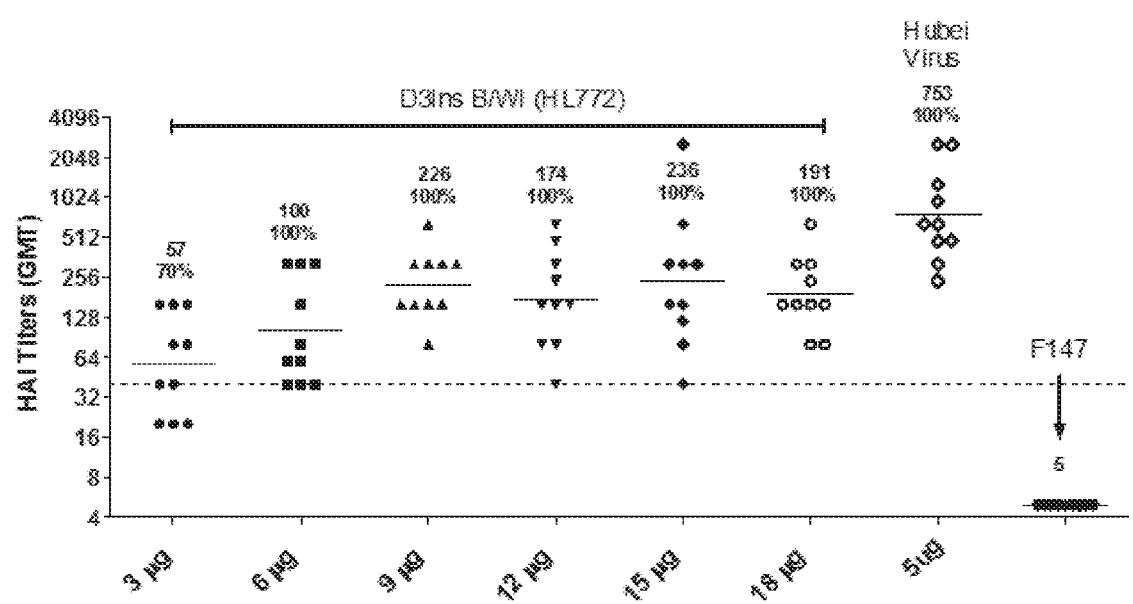

FIG. 27 shows HAI titers of rabbit sera following treatment with fusion protein STF2D3Ins B/WI (HL772, SEQ ID NO: 126), positive control Hubei virus, or formulation buffer (F147). Values are plotted individually with GMTs and seroconversion.

Figure 28A:
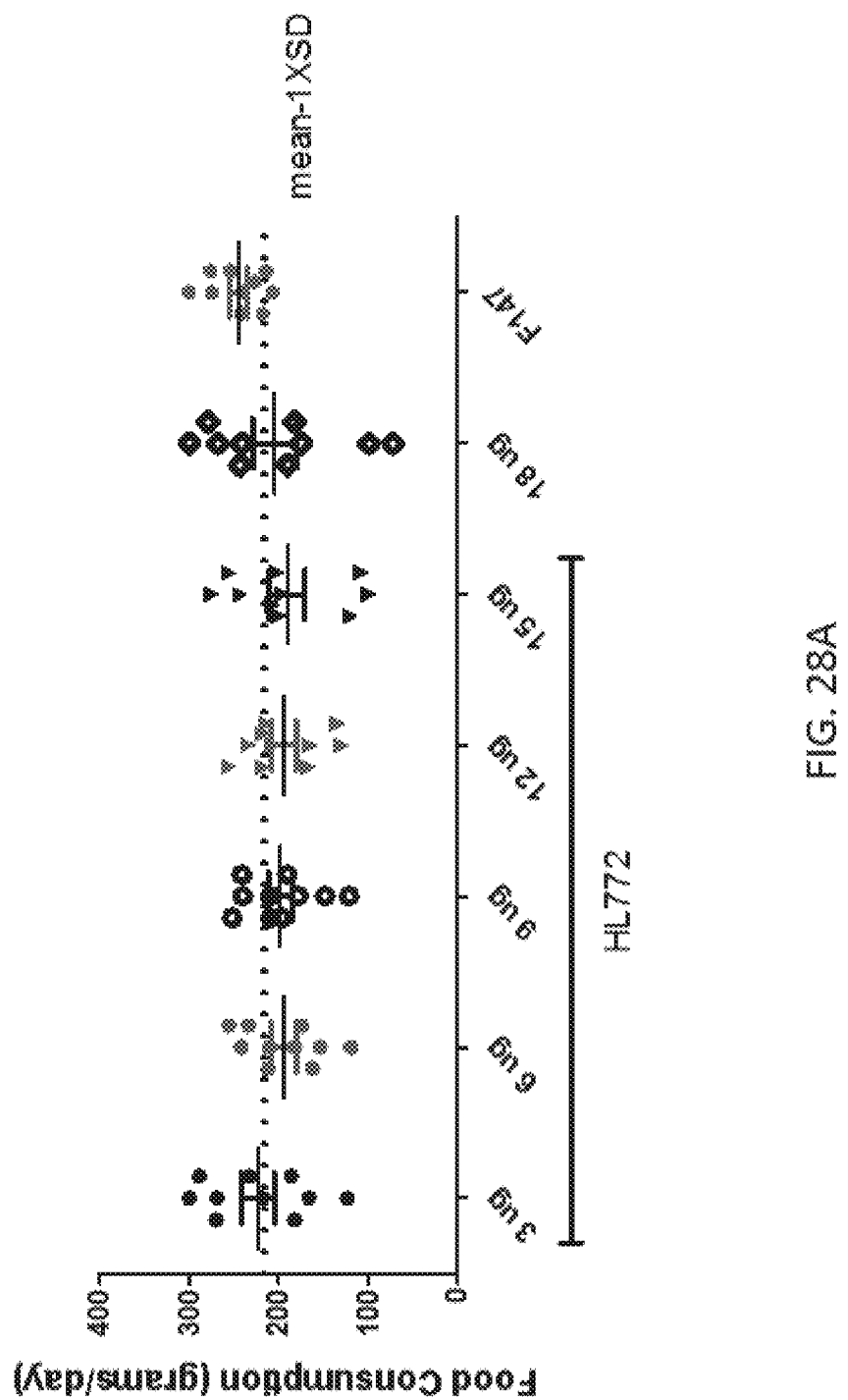
Figure 28B:
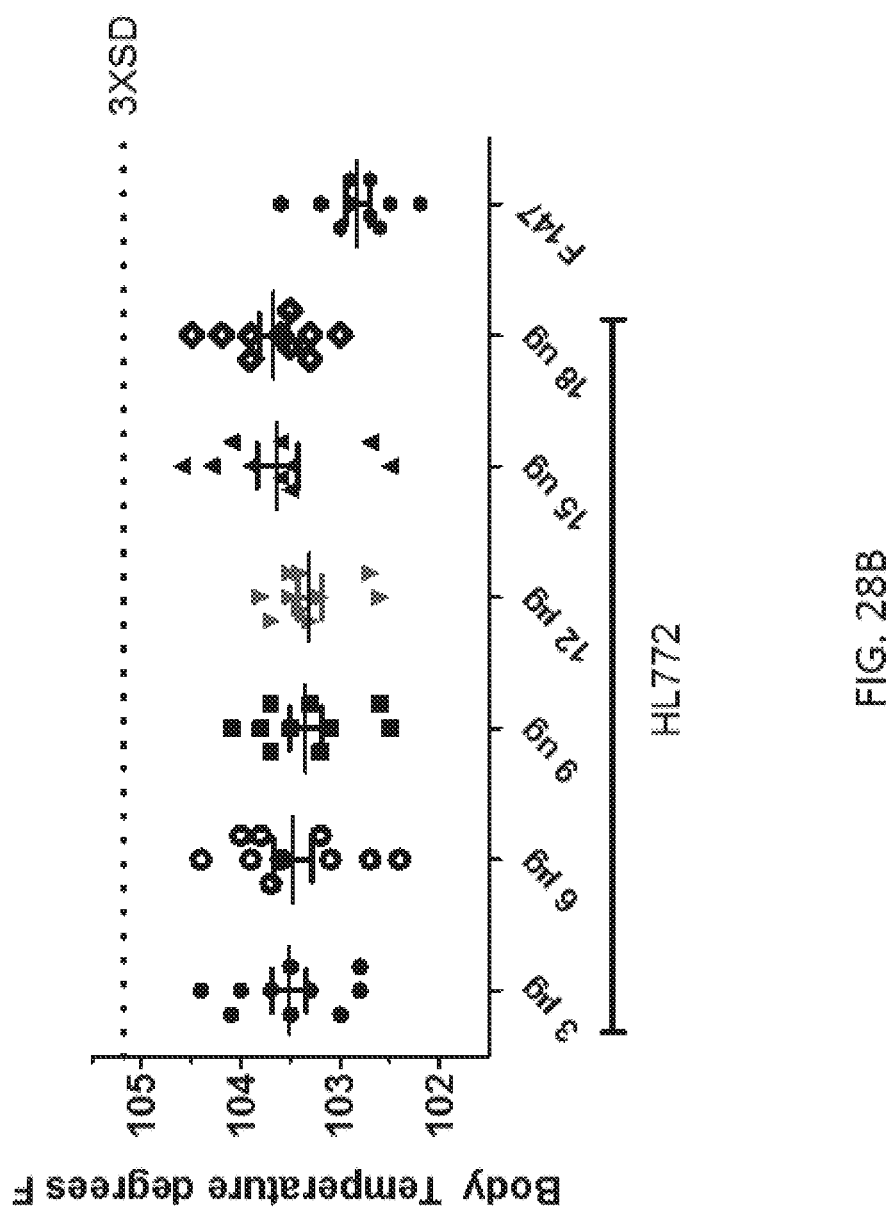
Figure 28C:
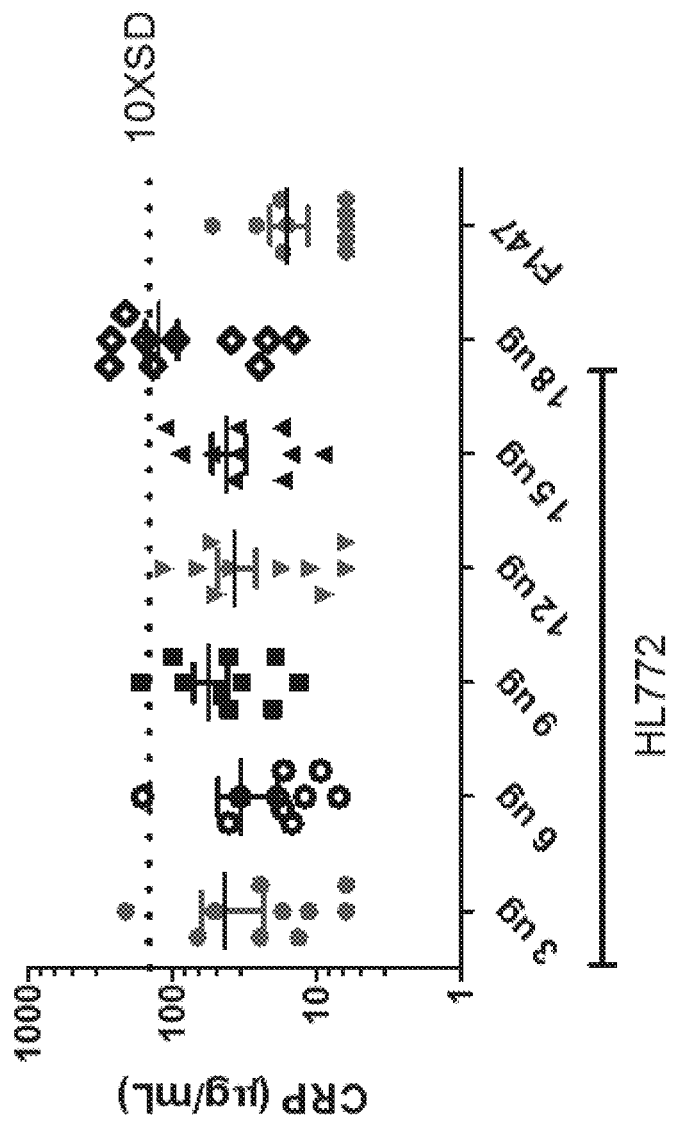

FIGS. 28A-28C show reactogenicity of the HL772 fusion protein (SEQ ID NO: 126) or buffer control (F147) in rabbits. Groups of 10 rabbits were immunized once with the dose indicated on the x-axis. FIG. 28A depicts food consumption measured about 24 hours after immunization. FIG. 28B depicts temperature measured rectally about 6 hours post-immunization. FIG. 28C depicts CRP was measured from serum taken about 24 hours after prime after the initial immunization (also referred to as "prime"). Data for all measures are shown as results of individual rabbits with lines representing means and standard error of the mean. Dotted lines represent the safety threshold calculated using the data from formula control rabbits.

Figure 29:

FIG. 29 depicts loops in domain 3 for *S. typhimurium* FliC (SEQ ID NO: 1) based on a known crystal structure and predicted loops in *S. typhimurium* FljB (SEQ ID NO: 2).

FIG. 30 depicts predicted insertion sites in domains 0, 1, 2 and 3 of *S. typhimurium* FljB (SEQ ID NO: 2) for fusion with antigens, including insertion sites in a loop of domain 3. Domain 0 is predicted at amino acid residues 1-46 and amino acid residues 465-506; Domain 1 is predicted at amino acid residues 47-176 and amino acid residues 415-464; Domain 2 is predicted at amino acid residues 177-190 and amino acid residues 292-414; and Domain 3 is predicted at amino acid residues 191-291. The amino acid number of boundaries between domains 0, 1, 2 and 3 and insertion sites are also indicated.

Figure 31:
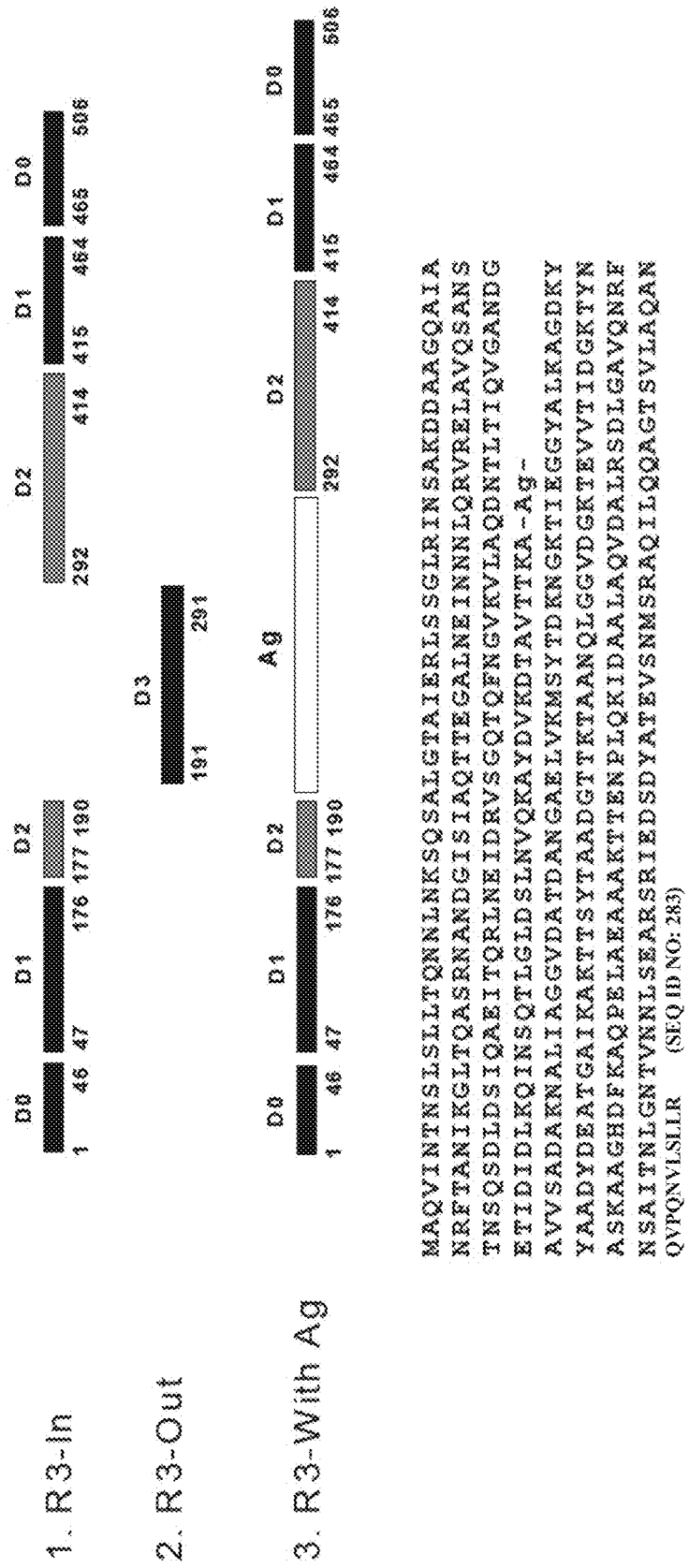

FIG. 31 depicts the domains (D0, D1, D2, D3) of a flagellin construct (SEQ ID NO: 283) and a fusion protein that includes, in sequence, the amino-domain 0, the amino-domain 1, the amino-domain 2, the carboxy-domain 2, the carboxy-domain 1 and the carboxy-domain 0 of flagellin. The antigen (Ag) is inserted between the amino-terminus and carboxy-terminus of domain 2 of the flagellin construct. The flagellin construct is referred to herein as "the R3 construct" (SEQ ID NO: 283) and lacks a domain 3, which is present in the naturally occurring flagellin (SEQ ID NO: 2).

Figure 32:
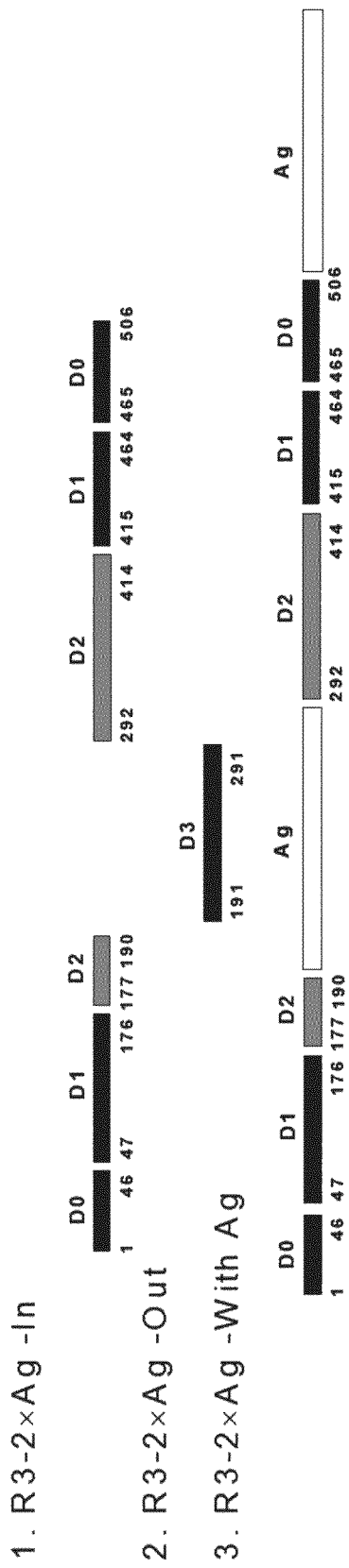

FIG. 32 depicts the domains (D0, D1, D2, D3) of a flagellin construct (SEQ ID NO: 284) and a fusion protein that includes, in sequence, the amino-domain 0, the amino-domain 1, the amino-domain 2, the carboxy-domain 2, the carboxy-domain 1 and the carboxy-domain 0 of the flagellin. Two antigens (Ag) are in the fusion protein. An antigen is fused between the amino-domain 2 and the carboxy-domain 2 of the flagellin construct. Another antigen is fused to the carboxy-terminal amino acid of the Domain 0 of the flagellin construct. The flagellin construct is referred to herein as "the R3-2xAg" construct, which lacks a domain 3 of the naturally occurring flagellin (SEQ ID NO: 2).

DETAILED DESCRIPTION OF THE INVENTION

The features and other details of the invention, either as steps of the invention or as combinations of parts of the invention, will now be more particularly described and pointed out in the claims. It will be understood that the particular embodiments of the invention are shown by way of illustration and not as limitations of the invention. The principle features of this invention can be employed in various embodiments without departing from the scope of the invention.

The invention is generally directed to compositions that include fusion proteins having an antigen with an isoelectric point greater than about 7.0 that activate Toll-like Receptor 5 and use of the fusion proteins in compositions to stimulate immune responses in a subject, such as protective immune responses.

A threshold of TLR5 signaling must be reached to promote the immunogenicity of fusion proteins that include flagellin and antigens. However, excess TLR5 signaling heightens proinflammatory cytokine response that can elicit systemic reactogenicity (e.g., unwanted side-effects, such as fever, weight loss) in vivo. Fusion proteins that include flagellin must activate TLR5 signaling to promote an adaptive immune response to the antigen with an isoelectric point greater than about 7.0, while simultaneously remaining below a threshold of TLR5 signaling that results in unacceptable reactogenicity.

Mouse and rabbit animal models to assess the minimal TLR5 activity required for a fusion protein that includes flagellin to be immunogenic (mouse model) and the maximal TLR5 activity associated with a well tolerated composition that includes a fusion protein of flagellin for use in a vaccine (rabbit model) have been developed, as described herein. In the mouse TLR5 activity model, when a mouse is immunized with about 1 µg of a fusion protein, the fusion protein must elicit at least about 32 pg/ml of IL6 and about 80 pg/ml of TNF in the serum about 3 hours post immunization to be considered immunogenic. In the rabbit model, a dose that elicits levels of food consumption that are greater than about 1 standard deviation below the mean of a buffer control, rises in body temperature that are greater than about 3 standard deviations away from the mean of the control and rises in C-reactive protein (CRP) that are greater than about 10 standard deviations away from the mean of the buffer control are likely to be reactogenic (e.g., have negative, unwanted side effects) in a human. The dose range for which a composition of the invention would be considered useful as a vaccine remains non-reactogenic in the rabbit model and is described as the "safety window." The dose range for which a composition of the invention would be considered useful as a vaccine is immunogenic, yet remains non-reactogenic in pre-clinical and clinical models is described as the "therapeutic window." The fusion proteins properly balance activation of TLR5 signaling and adaptive immune responses to the antigen to achieve a therapeutic window that is acceptable for use in methods to stimulate protective immunity.

Full length flagellin, without fusion to any antigen, or flagellin fused to an antigen at the carboxy-terminus of the flagellin have the narrowest safety window for use in compositions to stimulate immune responses in subjects because such compositions trigger a maximal TLR5 signaling response. Antigens with an isoelectric point less than about 7.0 fused to R3 constructs of flagellin, in which domain 3 of flagellin is entirely replaced with an antigen (U.S. application Ser. No. 12/905,584), have a wider safety window, believed to be due, in part, to the ability of the antigen to sterically hinder the fusion protein binding to TLR5 to thereby rendering it a "partial agonist." Partial agonist activity of R3 flagellin fusion proteins have been described for A/Puerto Rico/08/34 and A/California/07/09 (Taylor, et al., *Vaccine* 30:5761-5769 (2012)).

There must be sufficient partial TLR5 agonist activity for a fusion protein that includes flagellin to generate an immune response to the antigen component. As described herein, antigens with isoelectric points greater than about 7.0 when fused to R3 and R32x constructs of flagellin, result in decreased TLR5 signaling in the mouse model of TLR5 activity (decreased stimulation of adaptive immune responses), and, thus, are poorly immunogenic. Antigens with isoelectric points greater than about 7.0 may result in intramolecular interactions between the negatively charged flagellin and the antigen. Fusion of an antigen with an isoelectric point greater than about 7.0 (e.g., about 7.0, about 7.5, about 8.0, about 8.5, about 9.0, about 9.5, about 10.0, about 10.5, about 11.0, about 11.5) to at least one loop in domain 3 of flagellin, is believed to form a configuration that maximizes the distance of the antigen from the TLR5 binding domain of flagellin to thereby preserve the ability of the fusion protein to activate TLR5 by flagellin binding to TLR5.

In an embodiment, compositions of the invention include a fusion protein comprising a flagellin and at least one antigen that has an isoelectric point greater than about 7.5 and that is fused to at least one loop of domain 3 of the flagellin. The fusion protein of the invention activates the Toll-like Receptor 5.

Fusion of the antigen to a loop of domain 3 of flagellin essentially retains domain 3 of flagellin in its tertiary structure. The phrase "essentially retains domain 3 of flagellin in its tertiary structure," as used herein, refers to maintenance of the tertiary structure of domain 3 of flagellin, which can be assessed by well-established in vivo and in vitro assays described herein that are known to one of ordinary skill in the art, including the ability of flagellin to activate TLR5 and to assess protective immunity.

"Fusion protein," as used herein, refers to a protein generated from at least two distinct components, a flagellin or a portion of a flagellin and an antigen or a portion of an antigen having an isoelectric point greater than or equal to 7.0, including antigens with an isoelectric point of at least one member selected from the group consisting of about 7.0, about 7.5, about 8.0, about 8.5, about 9.0, about 9.5, about 10, about 10.5 and about 11.0.

Fusion proteins of the invention can be generated recombinantly or by chemical conjugation using well-established techniques. A recombinant fusion protein can be generated by operably linking a nucleic acid sequence encoding a flagellin, or a portion of a flagellin that includes a domain 3, to a nucleic acid sequence encoding an antigen, such as an antigen that is at least a portion of an influenza viral antigen. Fusion proteins of the invention can include, for example, one, two, three, four or five, antigens fused to, for example, one, two, three, or four loops of domain 3 of one or more flagellin.

The isoelectric point (pI) of a protein is the pH at which a particular antigen carries no net charge. The isoelectric point of the antigen fused to the flagellin can be at least one member selected from the group consisting of about 7.0, about 7.5, about 8.0, about 8.5, about 9.0, about 9.5, about 10.0, about 10.5 and about 11.0.

The flagellin in the fusion proteins of the invention can be an *S. typhimurium* flagellin (UniProt accession number P06179 or P52616), such as an *S. typhimurium* flagellin selected from the group consisting of SEQ ID NOS: 1 and 2; *E. coli* flagellin (UniProt accession number A0PCV8), such as, for example, SEQ ID NO: 3; *P. aeruginosa* flagellin (UniProt accession number P72151), such as SEQ ID NO: 4; *Aquifex aeolicus* VF5 flagellin (UniProt accession number 067803), such as SEQ ID NO: 5; *Helicobacter pylori* J99 Flagellin A (UniProt accession number P0A052), such as SEQ ID NO: 6; and *Legionella pneumophila* flagellin (UniProt accession number Q48824), such as SEQ ID NO: 7.

Figure 14:
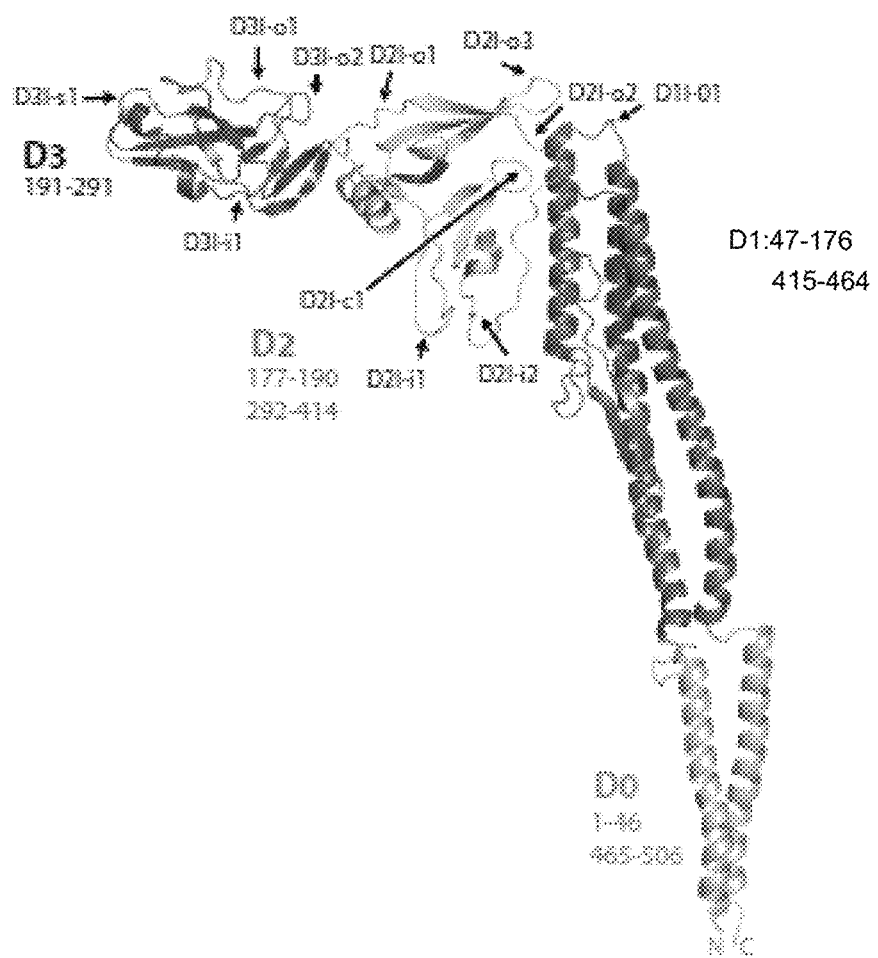

The flagellin employed in the fusion proteins of the invention can lack at least a portion of a carboxy-domain 0 or a portion of an amino-domain 0, for example, at least one member selected from the group consisting of about 5, about 10, about 14, about 15 and about 20 amino acids of the carboxy-domain 0 or a portion of an amino-domain 0. As shown in FIG. 14, flagellin includes a carboxy-domain 0, a carboxy-domain 1, a carboxy-domain 2, a domain 3, an amino-domain 2, an amino-domain 1, and an amino-domain 0. When flagellin assumes its tertiary structure, domains 2 and 3 form a juncture in which the flagellin folds on itself so that the most carboxy-amino acid of the carboxy-domain 0 of flagellin is adjacent to the most amino-amino acid of the amino-domain 0 of flagellin. Crystallographic studies of flagellin have identified the secondary and tertiary structure of *S. typhimurium* FliC flagellin (SEQ ID NO: 1) (PDB code: 1UCU).

The phrase "a loop of domain 3 of flagellin," as used herein, refers to a stretch of amino acids within domain 3 of flagellin that is, itself, devoid of secondary structures (e.g., β-sheets, α-helices), yet flanks adjacent stretches of amino acids in domain 3 that include secondary structures, such as β-sheets, α-helices. Loops of domain 3 in flagellin can be about 2, about 3, about 4, about 5, about 6, about 7 and between about 5 to about 30 amino acids in length.

Flagellin (FljB) from *Salmonella typhimurium* is depicted in SEQ ID NO: 2. Domain 3 of *Salmonella typhimurium* flagellin is between amino acid residue 191 and amino acid residue 291 of SEQ ID NO: 2. Flagellin from *E. coli* (UniProt accession number A0PCV8) is depicted in SEQ ID NO: 3. Domain 3 of *E. coli* flagellin of SEQ ID NO: 3 is predicted between amino acid residue 191 and amino acid residue 283 of SEQ ID NO. 3. *P. aeruginosa* flagellin (UniProt accession number P72151) is depicted in SEQ ID NO: 4 with domain 3 predicted between amino acid residue. Flagellin from *Aquifex aeolicus* VF5 (UniProt accession number 067803) is depicted in SEQ ID NO: 5. Domain 3 of *Aquifex aeolicus* flagellin is predicted between amino acid residue 197 and amino acid residue 302 of SEQ ID NO: 5. The flagellin A from *Helicobacter pylori* J99 (UniProt accession number P0A052) is depicted in SEQ ID NO: 6. Domain 3 of *Helicobacter pylori* J99 of SEQ ID NO: 6 is predicted between amino acid residue 189 and amino acid residue 283 of SEQ ID NO: 6. The flagellin from *Legionella pneumophila* (UniProt accession number Q48824) is depicted in SEQ ID NO: 7. Domain 3 of *Legionella pneumophila* flagellin of SEQ ID NO: 7 is predicted between amino acid residue 189 and amino acid residue 283 of SEQ ID NO: 7.

X-ray crystallography of *Salmonella typhimurium* FliC flagellin (SEQ ID NO: 1) shows that domain 3 of flagellin includes 6 loops (FIG. 29). The loops in domain 3 of *Salmonella typhimurium* flagellin SEQ ID NO: 1 are from amino acid residues 211 to 212 (loop 1); amino acid residues 217 to 219 (loop 2); amino acid residues 223 to 229 (loop 3); amino acid residues 237 to 242 (loop 4); amino acid residues 250 to 255 (loop 5) and amino acid residues 259 to 275 (loop 6).

FIG. 29 identifies the predicted loops (gray) in domain 3 of *Salmonella typhimurium* FljB flagellin (SEQ ID NO: 2) and compares the location in the sequence to the loops in domain 3 of *Salmonella typhimurium* FliC flagellin (SEQ ID NO: 1). Darkly shaded arrows depict secondary structures in domain 3 of *S. typhimurium* FliC, such as β-sheets and α-helices.

FIG. 30 depicts the amino acid sequence of *Salmonella typhimurium* FljB flagellin (SEQ ID NO: 2), boundaries of domain 0, 1, 2 and 3, and potential sites of fusion of antigens having isoelectric points greater than about 7.0 in loops of domain 3 of the flagellin. In an embodiment, the site of fusion of an antigen having an isoelectric point greater than about 7.0 is D3I-i1 (also referred to as "D3Ins-i1") between amino acid residues 259 and 260 of SEQ ID NO: 2 in loop 5 of domain 3 (see FIG. 29). In another embodiment, the site of fusion of an antigen having an isoelectric point greater than about 7.0 is D3I-o1 (also referred to as "D3Ins-o1") between amino acid residues 277 and 278 of SEQ ID NO: 2 in loop 6 of domain 3 (see FIG. 29).

In another embodiment, the D3I-o1 site of fusion of an antigen having an isoelectric point greater than about 7.0 is between amino acid residues 274 and 275 of SEQ ID NO: 4 in predicted loop 6 of domain 3. In still another embodiment, the D3I-o1 site of fusion of an antigen having an isoelectric point greater than about 7.0 is between amino acid residues 274 and 275 of SEQ ID NO: 5 in predicted loop 6 of domain 3.

In another embodiment, the D3I-i1 site of fusion of an antigen having an isoelectric point greater than about 7.0 is between amino acid residues 258 and 259 of SEQ ID NO: 4 in predicted loop 5 of domain 3. In still another embodiment, the D3I-o1 site of fusion of an antigen having an isoelectric point greater than about 7.0 is between amino acid residues 260 and 261 of SEQ ID NO: 5 in predicted loop 5 of domain 3.

The antigen can be fused to domain 3 of flagellin to generate constructs referred to as D3I-o1 and D3I-i1. "D3I-o1," as used herein, refers to insertion into a loop of domain 3 (Domain 3 Insertion) on the outer (o) or concave surface of flagellin, such as loop 6 OF SEQ ID NO: 2 or SEQ ID NO: 1. "D3I-i1," as used herein, refers to a loop of domain 3 on the inner (i) or convex surface of flagellin, such as loop 3 of SEQ ID NO: 2 and SEQ ID NO: 1. The tertiary structure of flagellin and portions of flagellin that would be considered concave and convex surfaces of flagellin are described, for example, by Samatey, et al., *Nature* 410:331-337 (2001).

The designation "c," with respect to an insertion of an antigen into a loop of domain 3 of flagellin (D3I-c1), refers to a "side-way" portion of domain 3 (FIG. 14).

The designation "s," with respect to an insertion of an antigen into a loop of domain 3 of flagellin (D3I-s1), means the "tip" of domain 3 of flagellin (FIG. 14).

Exemplary fusion proteins of the invention are shown in SEQ ID NOS: 126, 128-130, 151, 157-193.

The junction of the flagellin component and antigen component of fusion proteins of the invention results in a sequence of unique amino acids. For fusion proteins employed in methods of the invention to treat humans, if this unique sequence of amino acids at the juncture of the fusion of the flagellin component and the antigen component shares homology with a known human protein, the fusion protein has the potential to elicit an unwanted immune response to the human protein or a portion of the human protein. Upon selection of an insertion site in flagellin (e.g., a loop of domain 3, an adjacent portion of the carboxy- or amino-terminus of domain 2 of an R3 construct), the sequence of unique amino acids that would be created by fusion of the antigen to flagellin is assessed for its potential ability to elicit an unwanted immune response. In the evaluation, a probe of about 10 to about 12 amino acids in length, which includes the flagellin antigen junction is used to probe a database of known human genome sequences. If homology is identified for a stretch of amino acids greater than about 5 amino acids, then the junction sequence is modified with an amino acid substitution of, for example, 1, 2, 3, 4, 5, or 6 amino acids to decrease the homology. The order of preferred amino acids for use in the modification is serine, threonine, alanine and glycine. Generally, a single amino acid substitution is sufficient to modify the homology. For example see SEQ ID NO: 283 for the native FljB sequence without domain 3. For example, in an R3 construct of flagellin, Arg405 of SEQ ID NO: 283 can be modified to an alanine residue to generate SEQ ID NO: 284. Alternatively, Ala191 of SEQ ID NO: 283 can be modified to a serine residue, Arg405 of SEQ ID NO: 283 can be modified to an alanine and a serine residue can be added to the modified alanine residue (i.e., the most carboxy-terminus amino acid) to generate SEQ ID NO: 285. An exemplary fusion protein with modified amino acid residues at the junction of fusion of the antigen and the flagellin is SEQ ID NO: 268, where an HA1-2 portion of SEQ ID NO: 286 is fused to a flagellin of SEQ ID NO: 285. In SEQ ID NO: 268, the junctions of the fusion of the antigen and the flagellin are at Ala190 and Gly191; Ser413 and Ser414; and Ala628 and Ser629 with Gly630.

In an embodiment, the flagellin employed in the fusion protein of the invention lacks at least one member selected from the group consisting of at least a portion of the carboxy-domain 0 and at least a portion of an amino-domain 0.

In another embodiment at least one additional antigen is fused to the flagellin at a site that is distinct from fusion of the antigen to a loop of domain 3 of the flagellin. The additional antigen can be an antigen similar to the antigen fused to at least one loop of domain 3 of the flagellin. Alternatively, the additional antigen can be an antigen that is different (also referred to herein as "distinct") from the antigen that is fused to at least one loop of domain 3 of the flagellin. For example, at least a portion of an influenza hemagglutinin antigen, such as an HA1-1 or an HA1-2 portion, can be fused to a loop of domain 3 (e.g., between amino acid 277 and amino acid 278 of loop 3 of SEQ ID NO: 2) of flagellin and a different portion of an influenza hemagglutinin antigen, such as HA1-1L, can be fused to a different loop of domain 3, such as between amino acids 259 and 260 of loop 5 of SEQ ID NO: 2.

In another embodiment, the site of insertion of an antigen in a loop of domain 3 of flagellin can be 1, about 2, about 3, about 4, about 5, about 6, about 7, about 8, about 9, about 10, amino acids towards the carboxy-domain 2 or an amino-domain 2 of flagellin from the insertion sites identified in FIGS. 14, 29 and 30. For example, with reference to SEQ ID NO: 2, a loop of domain 3 to which the antigen is fused is between amino acid residues 277 and 278 (e.g., D3I-o1) (FIG. 30). Alternatively, fusion of the antigen can occur between amino acid 266 and 282 of SEQ ID NO: 2.

Likewise, with reference to SEQ ID NO: 2, a loop of domain 3 to which the antigen is fused is between amino acid residues 259 to 260 (D3I-i1) or amino acid residues 260 to 261. The insertion site in a loop of domain 3 in the D3I-i1 fusion protein of SEQ ID NO: 2 is between amino acid residues 190 to 191 or between amino acid residues 291 to 292.

In another embodiment, about 2 to about 4 amino acid residues in the loop of domain 3 can be deleted prior to fusion with the antigen with an isoelectric point greater than about 7.0. The deletions would be designed so that adjacent secondary structures in the flagellin would not be disrupted. Such deletions in at least one loop of domain 3 of flagellin may be employed when fusing flagellin to relatively large antigens.

In a preferred embodiment, the flagellin for use in the fusion proteins is a flagellin that includes at least one member selected from the group consisting of SEQ ID NOS: 1-7. The antigen is fused between amino acid residue 191 and amino acid residue 285 of SEQ ID NO: 1, which is within a loop of domain 3 of flagellin.

In a particular embodiment, the antigen that is fused to a loop of domain 3 of flagellin is an influenza viral antigen, in particular, an influenza B viral antigen.

In another embodiment the influenza viral antigen is at least a portion of an influenza A antigen subtype (H3, H7, H5 or H9). The influenza A antigen subtype can be at least one member selected from the group consisting of the H3, H5, H7 and H9. An additional influenza A antigen subtype can be at least one member selected from the group consisting of an H1 and an H2 subtype, (H1 subtype or H2 subtype).

In a particular embodiment, the influenza viral antigen is hemagglutinin, in particular, a portion of a hemagglutinin antigen that includes at least a portion of a globular head of the hemagglutinin antigen. The portion of an influenza viral hemagglutinin employed in the fusion proteins of the invention preferably includes at least a portion of a globular head of hemagglutinin that includes a sialic acid binding site. The portion of the globular head of the hemagglutinin includes at least one β-sheet at the bottom of the globular head that causes the globular head to essentially retain its tertiary structure.

"A sialic acid binding site," as that phrase is used herein in reference to the portion of the protein from the naturally occurring viral hemagglutinin, means a part of the influenza viral hemagglutinin that has the capacity to interact with sialic acid residues. "A sialic acid binding site" is also referred to herein as "a sialic acid binding domain."

"At least a portion," as used herein, refers to any part of the antigen or flagellin that is less than the entirety of the antigen or flagellin.

"A globular head," as that phrase is used herein, refers to a portion of a protein of an influenza viral hemagglutinin that includes the receptor or sialic acid binding regions. "Globular head," is also referred to herein as a "globular domain." The globular head of viral hemagglutinin proteins has been determined based on x-ray crystallography as described, for example, by Wilson I. A., et al. Nature 289:366-373 (1981); Chen, J., et al., *Cell* 95:409-417 (1998); Ha Y., et al., *The EMBO Journal* 21:865-875 (2002); Russell, R. J., et al., *Virology* 325:287-296 (2004); and Cox, N. J., et al., In: Toply and Wilson's Microbiology and Microbial Infections, eds. B W J Mathy, et al., Vol. 1 ($9^{th}$ ed.) New York, N.Y., Oxford Univ. Press, Ch. 32, p. 634 (1998). The globular head of an influenza viral hemagglutinin is a component of the HA1 subunit of influenza viral hemagglutinin. In addition to the receptor binding domain, the globular head can include the E⁻subdomain and F⁻subdomain as described, for example, by Ha, Y., et al. *The EMBO Journal* 21:865-875 (2002).

The phrase, "causes the globular head to essentially retain its tertiary structure," as used herein, refers to maintenance of the tertiary structure of the globular head to thereby mimic the tertiary structure of the globular head in the naturally occurring influenza viral hemagglutinin, which can be assessed by the ability to generate a sufficient immune response to stimulate a protective immune response in a subject in vivo or viral neutralization in in vitro assays, as described herein.

Influenza viruses are single-stranded RNA viruses that belong to the viral family Orthomyxoviridae. Influenza viruses are divided into three types (A, B, C) determined by the antigenic differences in ribonucleoprotein (RNP) and matrix (M) antigens of the viruses. Influenza A virus naturally infects humans and several other mammalian species, including swine and horses, and a wide variety of avian species, and causes epidemics and pandemics in the human population. Influenza B virus appears to naturally infect only humans and seals and can cause epidemics in humans. Influenza C virus has been isolated from humans and swine, but generally does not occur in epidemics and usually results in mild disease in humans.

Mature influenza virions are enveloped with a pleomorphic structure ranging in diameter from about 80 to about 120 nm. The single-stranded RNA genome is closely associated with a helical nucleoprotein and is present in seven (influenza C) or eight (influenza A and B) separate segments of ribonucleoprotein (RNP), each of which has to be present for successful replication of the virus. The segmented genome is enclosed within an outer lipoprotein envelope. Matrix protein 1 (MP1 or also referred to herein as "Ml") lines the inside of the outer lipoprotein envelope and is bound to the RNP.

Hemagglutinin (HA) is a surface glycoprotein on a virus (e.g., an influenza virus) that is responsible for binding to N-AcetylNeuraminic Acid (NeuNAc; also referred to herein as "sialic acid") on host cells and subsequent fusion of viral and host membranes. HA acquired its name by virtue of its ability to cause red blood cells to clump, or agglutinate. Influenza HA consists of the three monomeric (HA0) subunits. HA performs two critical functions during the infection process: binding to a cell surface sialyloligosaccharide receptor and fusion of virus and host cell membrane. Following binding of the HA to the plasma membrane of a host cell, the host cell membrane engulfs the virus in an endosome and attempts to digest the contents of the endosome by acidifying its interior and transferring it to a lysosome in the host cell. However, the acidic environment of the lysosome destabilizes HA, resulting in partial unfolding of HA0 which exposes a protease-sensitive site (the maturational cleavage site) that is cleaved by a host protease to form HA1 and HA2 subunits which are connected by a single disulfide bond (Wiley, D. C., et al., *Annu. Rev. Biochem.* 56:365-394 (1987)). Cleavage occurs at a specific amino acid residue and generates a hydrophobic amino terminus for the HA2 subunit. This hydrophobic terminus of HA2 mediates fusion between the viral envelope and the endosomal membrane of the host cell and releases the contents of the virion into the cytoplasm of the cell, a process known as uncoating. Thus, cleavage of the HA polypeptide is a requirement for infectivity.

The crystal structure of several viral hemagglutinins has been determined (see, for example, Wilson, I. A., et al., *Nature* 289:366-373 (1981); Chen, J., et al., *Cell* 95:409-417 (1998); Ha, Y., et al., *The EMBO Journal* 21: 865-875 (2002); Russell, R. J., et al., *Virology* 325:287-296 (2004); and Cox, N. J., et al., In: *Toply and Wilson's Microbiology and Microbial Infections*, eds. B. W. J. Mathy, et al., Vol. 1 ($9^{th}$ ed.) New York, N.Y., Oxford Univ. Press, Ch. 32, p. 634 (1998)). X-ray crystallographic structures show that HA is folded into two structural components or domains—a globular head and a fibrous stalk (see, for example, FIG. 1). The globular head includes HA1, including that part of HA1 that binds to sialic acid (also referred to as the "receptor binding site or domain" or "sialic acid binding site or domain"), and antiparallel β-sheets. The fibrous stalk is more proximal to the viral membrane and includes the HA2 subunit and part of HA1, including the cleavage site between HA1 and HA2.

There are seventeen known subtypes of Influenza A HA (H1-H17) that share between about 40 to about 60% sequence identity (Tong, et al., *Proc. Natl. Acad. Sci.*, 109:4269-4274 (2012)). Influenza viruses containing all 17 HA subtypes have been isolated from, for example, avian species (H5, H7, and H9), equine (H3 and H7), seals (H3, H4 and H7), whales (H1 and H13) and swine (H1, H3, and H9). Subtypes of influenza A virus are generally named according to the particular antigenic determinants of HA (H, 17 major types) and neuraminidase (N, about 9 major types). For example, subtypes include influenza A (H2N1), A(H3N2), A(H5N1), A(H7N2), A(H9N2), A(H1/H0), A(H3/H0), A(H5/H0) and A(H7N9). In the last century, three subtypes of influenza A resulted in pandemics: H1 in 1918, 1977 and 2007; H2 in 1957 and H3 in 1968. In 1997, an H5 avian virus and in 1999, an H9 virus resulted in outbreaks of respiratory disease in Hong Kong.

HA from influenza type B viruses have been isolated from humans and seals and are not divided into subtypes, although influenza type B viruses are characterized by two antigenically different lineages, Yamagata and Victoria. Influenza type B virus strains from both the Yamagat and Victoria lineages typically co-circulate. Compositions used in influenza vaccines can include four antigens (i.e., "quadrivalent flu vaccines") that, in addition to the two A strains, include both the circulating B strains. Similar to influenza A HAs, X ray crystallographic studies of influenza B HAs have revealed four major antigenic regions that are located in the vicinity of the receptor binding site, which is in the globular head of the influenza B HA (Wang, Q., et al., *J. Virol.*, March: 3011-3020 (2008)).

A host infected with influenza can mount an antibody response to the globular head of HA that protects that host from subsequent infection with the same strain of virus by blocking the interaction between HA and the host cell, i.e., neutralizing the infectivity of the virus. Due to the low fidelity and high rate of influenza RNA replication, the virus is constantly experiencing minor mutations in the HA gene that preserve the globular head structure and host cell interaction, but may allow progeny virus to escape immune surveillance. These point mutations are referred to as "antigenic drift." In addition, if a single host is simultaneously infected with two different strains of influenza A, a new subtype of virus may emerge as a result of reassortment, or the exchange of the RNA segments, or genes, between different strains of influenza A viruses. The viruses emerging from reassortment present the human immune system with a new antigenic experience that usually results in high morbidity and mortality. This type of drastic antigenic change is known as "antigenic shift." Since type B influenza viruses circulate almost exclusively in humans, these viruses cannot undergo reassortment with animal strains and, thus, are changed only by antigenic drift.

Immunity to HA can reduce the likelihood of infection and severity of disease if infection does occur. HA is an important antigenic target and the efficacy of vaccines depends on the antigenic match between the vaccine strain and the circulating strain. Since the hemagglutinin protein readily undergoes antigenic shift and drift in order to evade the host's immune defense, traditional vaccines must be based on currently circulating influenza strains and annually updated. Annual updates of influenza vaccines are not only costly they also require significant amounts of production time and manufacturing infrastructure. A vaccine composition based on invariant regions of the virus may provide broadly cross-reactive protection.

Figure 1:
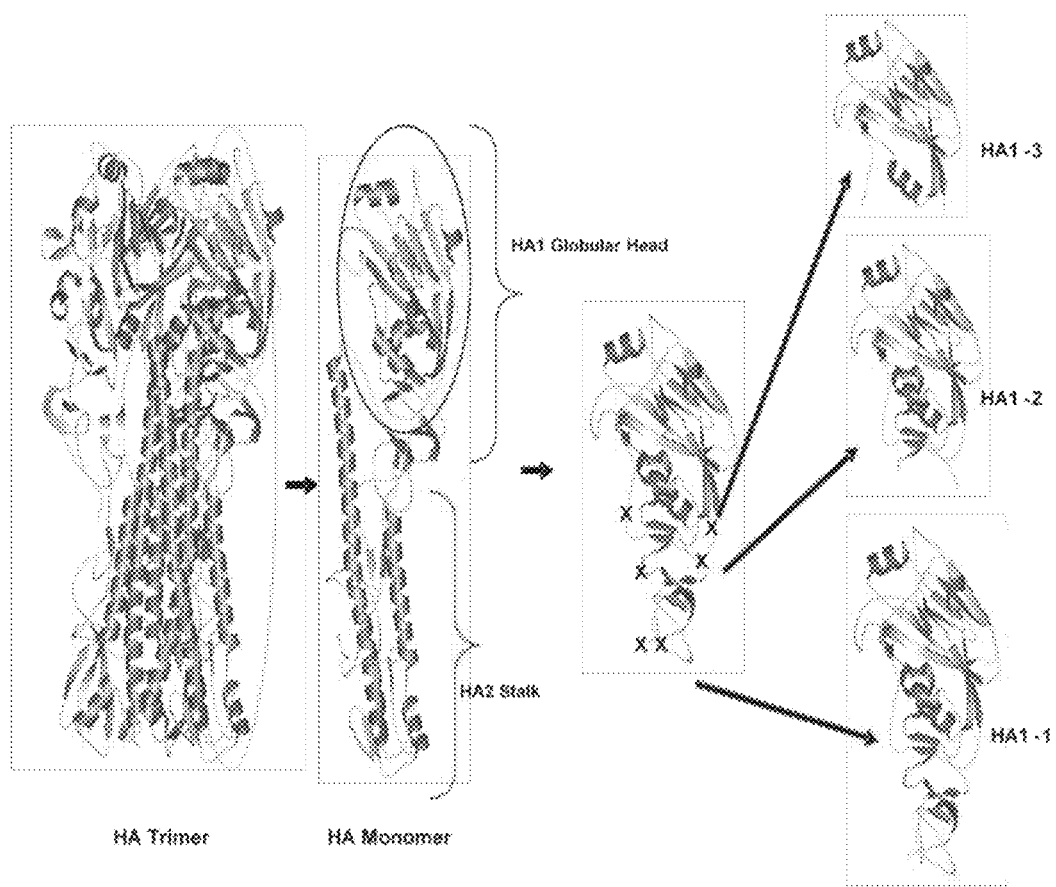
FIG. 1 depicts the hemagglutinin (HA) trimer, the full length HA1 subunit monomer with an HA1 globular head subunit (membrane distal), and an HA2 membrane subunit (proximal stalk subunit). Portions of the HA1 subunit, referred to as "HA1-1" and "HA1-2" are depicted. The portion of HA referred to as "HA1-3" has been employed as a negative control and lacks sufficient secondary structure to essentially maintain the tertiary structure of the globular head of the portion of HA.

Hemagglutinin forms a trimer on the surface of the influenza virus and infected cell. The monomeric subunits of the trimer are depicted in FIG. 1, and include an HA1 subunit (membrane distal globular head) and HA2 subunit (membrane proximal "stalk"). Portions of HA for use in the compositions of the inventor can include at least a portion of the globular head, which includes the cell surface receptor binding site and the majority of the neutralizing antibody epitopes. Portions of HA, referred to as HA1-1 and HA1-2 subunits, fused to flagellin (R3 and R32X constructs of flagellin, see, for example, U.S. patent application Ser. No. 12/905,584), have previously been employed in compositions that provide protective immunity to viral challenge (see, for example, U.S. Pat. No. 8,420,102). The HA1-1 and HA1-2 portions of HA include a portion of the globular head and differ in amino acid length and secondary structure. The HA1-1 and HA1-2 portions include at least a portion of the globular head of HA and at least one β-strand at the bottom of the portion of the globular head that maintains the portion of the globular head in its tertiary structure.

When fused to R3 or R32x formats (also referred to herein as "R3 constructs" or "R32x constructs") of flagellin, HA1-1 and HA1-2 portions of certain influenza viral antigens can provide protective immunity against viral challenge (see, for example, U.S. Pat. No. 8,420,102). Fusion proteins that include flagellin lacking the entirety of domain 3 and in which an HA antigen has been fused to the flagellin in the region of flagellin that was domain 3 are referred to as "R3 fusion proteins." "R32x fusion proteins (also referred to "R3.2x")" are R3 fusion proteins that include a second antigen, which is the same or distinct from the antigen in the region of flagellin that was domain 3, fused to the most carboxy-terminal amino acid of the carboxy-domain of flagellin (see, for example, U.S. patent application Ser. No. 12/905,584). For example, an HA1-1 portion can be fused in the region of flagellin that was domain 3 and an HA1-2 portion can be fused to the most carboxy-terminal amino acid of flagellin to form an R32x fusion protein.

In contrast, in certain influenza A strains, R3 and R3.2x fusion proteins that include portions of an influenza B HA, are poorly immunogenic, as shown herein. For example, influenza B fusion proteins that include an HA1-2 portion (SEQ ID NO: 45) of the Yamagata lineage strain B/Florida/4/2006, fused to flagellin in an R3 format (HL098, SEQ ID NO: 122) or an R2X format (HL118, SEQ ID NO: 287) or Victoria lineage strain B/Brisbane/60/2008, SEQ ID NO: 264 fused to flagellin in an R3format (HL169, SEQ ID NO: 147) or an R32X format (HL171, SEQ ID NO: 288) failed to elicit measurable levels of hemagglutination inhibition (HAI) titers, a standard measure of protective immunity against influenza virus. Every year, new multivalent blends of compositions for use as vaccines are developed as treatments to prevent and manage disease associated with viral influenza infection. For example, trivalent influenza vaccine (TIV) treatments contain two different inactivated influenza type A strains and one inactive influenza type B strain, e.g. FLUVIRIN®. Quadrivalent vaccine (QIV) treatments are available, e.g. FLUZONE® Quadrivalent vaccine, which contains two different inactivated influenza type A strains and two inactivated influenza B strains. Therefore, a need exists to develop new and effective fusion proteins targeting influenza B that can be included in multivalent compositions.

Influenza viral antigens fused to at least one loop of domain 3 of flagellin can be a portion of an influenza B viral antigen, such as a portion referred to herein as "HA1-1," "HA1-2" and "HA1-1L." Compositions that include influenza viral hemagglutinn antigens, such as HA1-1, HA1-2 and HA1-1L portions of influenza hemagglutinin, can be employed in methods to treat or prevent seasonal and pandemic influenza in subjects.

"A portion," as used herein with reference to an influenza viral antigen, for example, an influenza viral hemagglutinin antigen, refers to any part of the influenza viral hemagglutinin that is less than the entirety of the influenza viral hemagglutinin.

"HA1-1," as used herein, refers to a protein portion of a viral hemagglutinin that includes at least about one β-sandwich that includes the substrate binding site, which includes at least about two β-sheets, at least about two to about three short a-helixes, at least one small β-sheet and at least one additional small β-sandwich at the bottom of the molecule and at least about four disulfide bonds. The β-sandwich that includes the substrate binding site of the HA1-1 includes at least about four β-strands as the top sheet and at least about three to about four β-strands as the bottom sheet. At least about one a-helix of the HA1-1 portion is located by the side of β-sandwich that includes the substrate binding site and at least about one to about two are located at the bottom of the β-sandwich that includes the substrate binding site. The small β-sandwich of the HA1-1 can include at least about two to about three β-strands in each β-sheet; or about three to about four β-strands. Exemplary HA1-1 protein portions include SEQ ID NOs: 8-44. In a particular embodiment, the HA1-1 portion of HA includes a portion of the globular head of HA that has a β-sheet and a β-sandwich at the bottom of the globular head that essentially retains the globular head in its tertiary structure.

"HA1-2," as used herein, refers to a protein portion of a viral hemagglutinin that includes at least about one β-sandwich that includes the substrate binding site, at least about two to about three short a-helixes, at least about one small β-sheet at the bottom of the molecule and at least about two disulfide bonds. A β-strand in a viral hemagglutinin can include between about two to about 15 amino acids. A small β-strand can include about two amino acids; or between about two to about three amino acids; or between about two to four amino acids or between about two to about five amino acids. A small β-sheet can include between about two to about three β-strands; or between about three to about four β-strands. The β-sandwich that includes the substrate binding site of HAI-2 can further include at least about four β-strands as the top sheet and at least about three to about four β-strands as the bottom sheet. At least about one a-helix of the HA1-2 portion is located by the side of the β-sandwich that includes the substrate binding site and at least about one to about two are located at the bottom of the β-sandwich that includes the substrate binding site. Exemplary HA1-2 protein portions include SEQ ID NOs: 45-97 and 287. In a particular embodiment, the HA1-2 portion of HA includes a β-sheet at the bottom of a portion of the globular head of hemagglutinin.

A single polypeptide can exhibit several types of secondary structure. Without any stabilizing interactions, a polypeptide can assume a random-coil conformation. However, secondary structures, such as alpha(α)-helices and beta(β)-strands, can stabilize a protein or a portion of a protein. Lateral association of β-strands form β-sheets (also referred to herein as "β-pleated sheets"). Secondary structures can be located at the surfaces of the antigen (e.g., portion of the viral hemagglutinin) A tertiary structure of a protein is the three-dimensional arrangement of amino acid residues. In contrast to secondary structure, which is stabilized by, for example, hydrogen bonds, α-helices, β-strands, tertiary structure results from hydrophobic interactions between non-polar side chains of the antigen, such as a portion of an influenza viral hemagglutinin. The hydrophobic interactions hold the helices strands in random coils in a compact internal scaffold. The size and shape of a protein can depend on its primary amino acid sequence, as well as the number, size and arrangement of secondary structures.

Portions of influenza viral hemagglutinins for fusion to at least one loop of domain 3 of flagellin include at least a portion of a globular head having secondary structures at the bottom of the globular head that essentially retains the globular head in its tertiary structure. Such secondary structures include at least one β-sheet; at least one β-sheet and at least one β-sandwich; at least one β-sheet, at least one β-sandwich and at least two β-strands.

Portions of hemagglutinin employed in the composition of the invention that are fused to at least one loop of domain 3 of flagellin can lack a transmembrane domain and a cytoplasmic domain. The portions of hemagglutinin employed in the compositions of the invention can further lack at least a portion of the HA2 subunit or the entirety of the HA2 subunit of hemagglutinin.

Antigens that have an isoelectric point greater than about 7.0 can be fused to at least one loop of domain 3 of flagellin to form fusion proteins of the invention. The loops in domain 3, which can be characterized as "extended regions," may accommodate amino acid insertions of about 50 amino acids, about 100 amino acids, about 150 amino acids, about 200 amino acids, about 250 amino acids, about 300 amino acids, about 350 amino acids, about 400 amino acids, about 450 amino acids and about 500 amino acids in length, including insertions between about 50 to about 100 amino acids, between about 100 to about 250 amino acids and between about 250 amino acids to about 500 amino acids with minimal disruption of the tertiary structure of flagellin. For example, the fusion protein of SEQ ID NO: 126 (HL772) includes a portion of an influenza B/WI1 that is 249 amino acids in length; the fusion protein of SEQ ID NO: 128 (HL657) includes a portion of an influenza B/BR60 that is 250 amino acids in length; the fusion protein of SEQ ID NO: 129 (HL775) includes a portion of an influenza A/PE16 that is 275 amino acids in length; and the fusion protein of SEQ ID NO: 130 (HL1018) includes a portion of an influenza A/AH1 that is 282 amino acids in length.

The antigen with an isoelectric point greater than about 7.0 includes secondary structures, such as at least one β-sheet, at least one β-sandwich, at least one β-pleat and at least one α-helix, that maintain the antigen in its tertiary, compact configuration when the antigen is fused to a loop of domain 3 of flagellin, thereby minimally disrupting the tertiary structure of the loop of domain 3.

There are at least seventeen different HA antigens, the different HA antigens are classified as subtypes and identified as HA1 through H17. H1, H2 and H3 are found in human influenza viral antigens. Hemagglutinin on the influenza virion is a trimer (three copies of the HA polypeptides). The cleavage site for cell proteases on the HA protein is located near the viral membrane. The uncleaved form of hemagglutinin is referred to as HA0. After cleavage by a cellular enzyme, two subunits of HA are produced, specifically the HA1 subunit and the HA2 subunit. The two subunits remain together on the surface of the virus particle. The HA2 subunit that is produced by cleavage contains a sequence of hydrophobic acids referred to as a fusion peptide.

In an additional embodiment, the portion of hemagglutinin that is fused to at least one loop of domain 3 of flagellin has at least one β-sheet at a bottom of the portion of the globular head, such as HA1-2 portions of SEQ ID NOS: 45-97. In addition to at least one β-sheet at the bottom of a portion of the globular head, the portion of hemagglutinin fused to at least one loop of domain 3 of flagellin can further include at least one β-sandwich at the bottom of the globular head and, optionally, at least two β-strands at the bottom of the portion of the globular head. Thus, the portion of influenza viral hemagglutinin fused to at least one loop of domain 3 of flagellin can include at least one β-sheet, at least one β-sandwich, and at least two β-strands at the bottom of a portion of a globular head of influenza viral hemagglutinin, which is referred to herein a "HA1-1L" portion of hemagglutinin. Exemplary HA1-1L portions of HA are SEQ ID NOS: 98-121, 228 and 273-277.

Fusion proteins of the invention can include an amino acid linker between at least one of an amino-terminus or a carboxy-terminus of the antigen and the loop of domain 3 of the flagellin. The amino acid linker can be between about 1 to about 10 amino acids in length, such as about 2, about 3, about 4, about 5, about 8 or about 9 amino acids in length. Preferred amino acid residues would include amino acid residues without side chains or amino acid residues with small side chains, such as glycine, alanine or serine, including combinations of glycine, serine and alanine. For example, amino acid residues of a linker of at least about 9 amino acids in length could be fused to the carboxy-terminus of an antigen of SEQ ID NO: 125 (HL352) in a fusion protein. Exemplary antigens fused to a linker are SEQ ID NOS: 46, 48, 50, 52, 54, 56, 58, 60, 62, 89, 91, 93-97, 228, 273-277. Amino acid residues that comprise the amino acid linker can have an isoelectric point of between about 3 and about 7 and between about 4 and about 7. Amino acid linkers can include 2, 3, 4 or 5 negatively charged amino acid residues, such as aspartic acid or glutamic acid. Exemplary amino acid linkers are described, for example, in PCT/US2012/000099 (WO 2012/115715), by Song, L. et al., and PCT/US2012/000367 (WO 2013/066365), by Song, L., et al. It is believed that negatively charged amino acids at or adjacent to (about 1, 2, 3 or 4 amino acids) the amino- or carboxy-terminus of the antigen at the site of fusion to a loop of domain 3 reduce undesirable intramolecular interactions between the negatively charged flagellin and a positively charged antigen thereby tethering the antigen at the site of fusion. Amino acid linkers are devoid of secondary structures, such as α-helices and β-sheets.

In an embodiment, the linker can include amino acid residues that are native to the naturally occurring hemagglutinin and adjacent to the portion of HA (e.g., HA1-1, HA1-2, HA1-1L) being fused to a loop of domain 3, such as the 9 amino acid residues (also referred to herein as "extension") of SEQ ID NO: 123, which includes 2 negatively charged amino acid residues. For example, the fusion protein of SEQ ID NO: 154 (HL719, which is an R3 construct) includes a portion of influenza B Wisconsin construct (HA1-2 of SEQ ID NO: 50) and 9 amino acids (SEQ ID NO: 123) of the naturally occurring hemagglutinin, which has 2 negatively charged residues. Exemplary antigens fused to the same linker are SEQ ID NOS: 46, 48, 52, 54, 56, 58, 60, 62, 89, 91, and 93. The fusion protein of SEQ ID NO: 152 (HL724, which is an R3 construct) includes a portion of an influenza B Wisconsin HA1-2 that has the 9 amino acids of SEQ ID NO: 123 with an additional 3 negatively charged amino acid residues in the portion of HA. Exemplary antigens fused with the same modifications are SEQ ID NOS: 94-97.

An amino acid linker used to fuse the antigen to at least one loop of domain 3 of flagellin can be about 1 to about 10 amino acids in length, such as about 2 amino acids, about 3 amino acids, about 4 amino acids, about 5 amino acids, about 6 amino acids, about 7 amino acids, about 8 amino acids, about 9 amino acids and about 10 amino acids in length. Preferably, amino acid linkers include amino acid residues that have small or no side chains, such as glycine, alanine and serine. In a particular embodiment, the amino acid linker that would be fused to the carboxy-terminus of the loop of domain 3 of flagellin has an overall negative charge, such as an isoelectric point between about 2 to about 4.

In a further embodiment, the invention is a composition comprising at least three fusion proteins that each activate a Toll-like Receptor 5. The first fusion protein includes a first flagellin and a first influenza A viral hemagglutinin antigen that has an isoelectric point greater than about 6.0, such as an isoelectric point between about 6.5 to about 7.0, fused to a portion of the first flagellin. The second fusion protein includes a second flagellin and a second influenza A viral hemagglutinin antigen that is distinct from the first influenza A viral hemagglutinin antigen and that has an isoelectric point greater than about 7.0, such as an isoelectric point between about 7.5 to about 8.5, about 7.8, about 8.0, about 8.5, about 9.0 and about 9.5, fused to a portion of the second flagellin. The third fusion protein includes a third flagellin and a first influenza B viral hemagglutinin antigen that has an isoelectric point greater than about 8.0, such as between about 8.0 to about 10.0, about 8.5, about 9.0, about 9.5 and about 10.0, and is fused to at least one loop of domain 3 of the third flagellin.

The composition that includes at least three fusion proteins that activate TLR5 can further include a fourth fusion protein that activates TLR 5. The fourth fusion protein includes a second influenza B viral hemagglutinin antigen that is distinct from the first influenza B antigen, and, that has an isoelectric point greater than about 8.0, such as between about 8.0 to about 10.0, about 8.5, about 9.0, about 9.5 and about 10.0, fused to at least one loop of domain 3 of a fourth flagellin.

In a particular embodiment, the first fusion protein of the composition that includes at least three fusion proteins that each activate TLR5 is a fusion protein that includes two similar portions of an influenza A hemagglutinin that have a portion of a globular head with a β-sheet at the bottom of the globular head (e.g., HA1-2) fused to an R32x construct of flagellin. This first fusion protein has one HA portion fused to the portion of the flagellin in the region where domain 3 was located and another similar HA portion fused to the carboxy-terminus of the portion of flagellin. An exemplary first fusion protein is SEQ ID NO: 268, which is a portion of influenza A California/07/2009.

In a particular embodiment, the second fusion protein of the composition that includes at least three fusion proteins that each activate TLR5 is a fusion protein that includes a second influenza A antigen that is distinct from the first influenza A antigen and has an isoelectric point greater than about 7.0. The second influenza A antigen is a portion of the globular head of HA that has a β-sheet, a one β-sandwich and two β-strands at the bottom of a portion of a globular head of influenza viral hemagglutinin (referred to herein a "HA1-1L") fused to an R3 construct of a portion of flagellin. The HA1-1L antigen replaces domain 3 of the flagellin in an R3 construct. An exemplary second fusion protein is SEQ ID NO: 269, which is a portion of influenza A Perth/16/2009.

In a particular embodiment, the third fusion protein of the composition that includes at least three fusion proteins that each activate TLR5 is a fusion protein that includes a first influenza B antigen that has an isoelectric point greater than about 8.0 and that is fused to a loop of domain 3 of a portion of a third flagellin, such as loop 6 between amino acid residues 277 and 278 of SEQ ID NO: 2. An exemplary third fusion protein is SEQ ID NO: 126 (HL772), which is a portion of influenza B Wisconsin/1/2010.

In a particular embodiment, the fourth fusion protein of the composition that includes at least three fusion proteins that each activate TLR5 is a fusion protein that includes a second influenza B antigen that has an isoelectric point greater than about 8.0 and that is fused to a loop of domain 3 of a portion of a fourth flagellin, such as loop 6 between amino acid residues 277 and 278 of SEQ ID NO: 2. The second influenza B antigen is distinct from the first influenza B antigen. An exemplary fourth fusion protein is SEQ ID NO: 158 (HL787), which is a portion of influenza B Bangladesh/5495/2009.

"Distinct," as used herein in reference to an antigen, protein or flagellin, means that the antigen, protein or flagellin is different than a first or additional (second, third, fourth, etc.) antigen, first or additional (second, third, fourth, etc.) protein or first or additional (second, third, fourth, etc.) flagellin. For example, an influenza A Perth/16/2009 hemagglutinin (HA) antigen is distinct from an influenza A California/07/2009 HA antigen. Likewise, an influenza B Wisconsin/1/2010 HA antigen is distinct from an influenza B Bangladesh/5495/2009 HA antigen.

FIG. 31 depicts the domains (D0, D1, D2, D3) of a flagellin construct (SEQ ID NO: 283) and a fusion protein that includes, in sequence, the amino-domain 0, the amino-domain 1, the amino-domain 2, the carboxy-domain 2, the carboxy-domain 1 and the carboxy-domain 0 of flagellin. An antigen (Ag) is fused between the amino- and carboxy-domain 2 of the flagellin construct. The flagellin construct of the fusion protein depicted in FIG. 31 lacks the D3 domain of flagellin and is referred to herein as an "R3 construct" or the "R3 form of flagellin" or "R3 flagellin construct" (SEQ ID NO: 283). "R3 (Replace Domain 3) construct," as used herein, means that Domain 3 of the flagellin has been replaced with an antigen, as previously described in U.S. patent application Ser. No. 12/905,584. For example, an antigen can be fused between amino acids 190 and 191 of SEQ ID NO: 283.

FIG. 32 depicts the domains (D0, D1, D2, D3) of a flagellin construct (SEQ ID NO: 284) and a fusion protein that includes, in sequence, the amino-domain 0, the amino-domain 1, the amino-domain 2, the carboxy-domain 2, the carboxy-domain 1 and the carboxy-domain 0 of flagellin. For example, the fusion protein depicted in SEQ ID NO: 284 has at least a portion of at least one antigen and at least a portion of at least one other antigen fused to two sites in a portion of flagellin. One antigen (also referred to as "first antigen") is fused between the amino-domain 2 and the carboxy-domain 2 of the flagellin construct. The other antigen, which can be distinct from the first antigen, is fused to the carboxy-terminal amino acid of the domain 0 of the flagellin construct. The flagellin construct depicted in FIG. 32 lacks the D3 domain of flagellin and is referred to herein as an "R3-2xAg construct" or the "R3-2xAg form of flagellin" or "R32x flagellin construct" or "R32x" or the "R32x form of flagellin" or "2xR3" or the "2xR3 form of flagellin" or the "R3/2x form of flagellin." "R3-2xAg construct," as used herein, means that Domain 3 of the flagellin is replaced with a one antigen and another antigen, such as a distinct antigen, is fused to the carboxy-terminus of domain 0, as previously described in U.S. patent application Ser. No. 12/905,584. For example, one antigen can be fused between amino acids 190 and 191 of SEQ ID NO: 284 and another antigen can be fused to the terminal carboxy amino acid (e.g., SEQ ID NOs: 268, 287 and 288).

In still another embodiment, the first influenza A viral hemagglutinin antigen of the compositions of the invention and for use in the methods of the invention includes at least a portion or the entirety of an HA1 subunit that has at least a portion of a globular head that includes at least one β-sheet at a bottom of the globular head; the second influenza A viral hemagglutinin antigen of the compositions of the invention and for use in the methods of the invention includes at least a portion or the entirety of an HA1 subunit having at least a portion of a globular head that includes at least one β-sheet, at least one β-sandwich and at least two β-strands at the bottom of the portion of the globular head; and the first influenza B viral hemagglutinin antigen of the compositions of the invention and for use in the methods of the invention includes at least a portion or the entirety of an HA1 subunit that has at least a portion of a globular head that includes at least one β-sheet at a bottom of the globular head. The second influenza B viral hemagglutinin antigen of the compositions of the invention and for use in the methods of the invention includes at least a portion or the entirety of an HA1 subunit that has at least a portion of a globular head that includes at least one β-sheet at a bottom of the globular head.

In a further embodiment, the first influenza A viral hemagglutinin antigen of the compositions of the invention and for use in the methods of the invention includes at least a portion of an HA1 subunit that has at least a portion of a globular head that includes at least one β-sheet at a bottom of the globular head; the second influenza A viral hemagglutinin antigen of the compositions of the invention and for use in the methods of the invention includes at least a portion of an HA1 subunit having at least a portion of a globular head that includes at least one β-sheet, at least one β-sandwich and at least two β-strands at the bottom of the portion of the globular head; and the first influenza B viral hemagglutinin antigen of the compositions of the invention and for use in the methods of the invention includes at least a portion of an HA1 subunit that has at least a portion of a globular head that includes at least one β-sheet at a bottom of the globular head. The second influenza B viral hemagglutinin antigen of the compositions of the invention and for use in the methods of the invention includes at least a portion of an HA1 subunit that has at least a portion of a globular head that includes at least one β-sheet at a bottom of the globular head.

In another embodiment, the invention is a method of stimulating an immune response to an antigen in a subject. The method includes the step of administering to the subject a composition that includes a fusion protein that activates a Toll-like Receptor 5, the fusion protein comprising a flagellin and at least one antigen that has an isoelectric point greater than about 7.0 and that is fused to at least one loop of domain 3 of the flagellin. In a particular embodiment, the immune response that is stimulated in the subject in response to administration of the fusion protein provides protective immunity to a disease or an infection consequent to exposure of an organism that includes the antigens fused to the loop of domain 3 of flagellin. The method can further include the administration of an adjuvant.

In yet another embodiment, the invention is a method of stimulating an immune response in a subject, comprising the step of administering to the subject a composition that includes at least three fusion proteins each of which activates a Toll-like Receptor 5, wherein: (a) a first fusion protein includes a first flagellin and a first influenza A viral hemagglutinin antigen that has an isoelectric point greater than about 6.0 fused to a portion of the first flagellin; (b) a second fusion protein includes a second flagellin and a second influenza A viral hemagglutinin antigen that is distinct from the first influenza A viral hemagglutinin antigen and that has an isoelectric point greater than about 7.0 fused to a portion of the second flagellin; and (c) a third fusion protein includes a third flagellin and a first influenza B viral hemagglutinin antigen that has an isoelectric point greater than about 8.0 and is fused to at least one loop of domain 3 of the third flagellin.

In a further embodiment, the invention is a method of stimulating an immune response in a subject, comprising the step of administering to the subject a composition that includes at least four fusion proteins each of which activates a Toll-like Receptor 5, wherein: (a) a first fusion protein includes a first flagellin and a first influenza A viral hemagglutinin antigen that has an isoelectric point greater than about 6.0 fused to a portion of the first flagellin; (b) a second fusion protein includes a second flagellin and a second influenza A viral hemagglutinin antigen that is distinct from the first influenza A viral hemagglutinin antigen and that has an isoelectric point greater than about 7.0 fused to a portion of the second flagellin; (c) a third fusion protein includes a third flagellin and a first influenza B viral hemagglutinin antigen that has an isoelectric point greater than about 8.0 and is fused to at least one loop of domain 3 of the third flagellin; and (d) a fourth fusion protein that activates a Toll-like Receptor 5 includes a second influenza B viral hemagglutinin antigen that is distinct from the first influenza B viral hemagglutinin antigen and that has an isoelectric point greater than about 8.0 fused to at least one loop of domain 3 in the fourth flagellin.

In an embodiment, the method of the invention stimulates an immune response by administering four different fusion proteins (2 fusion proteins that include influenza A antigens and two fusion proteins that include influenza B antigens) each of which activate TLR5 signaling. The four fusion proteins can be administered in escalating doses. For example, an initial immunization can include all four fusion proteins administered in the same dose (e.g., about 1 µg or about 2 µg), followed by a second dose that is twice the first dose (e.g., about 2 µg or about 4 µg). Subsequent doses (a third or a fourth dose) can include further increases in the doses of fusion proteins that include influenza A to doses of about 6 µg to about 8 µg, while maintaining the dose of the fusion protein that includes influenza B at about 2 µg or 4 µg.

Doses of fusion proteins that include influenza A antigens in multivalent compositions can be at least one member selected from the group consisting of about 2 µg, about 4 µg, about 6 µg, about 10 µg, about 12 µg, about 14 µg, about 15 µg and about 20 µg doses. Doses of fusion proteins that include influenza B antigens in multivalent compositions can be at least one member selected from the group consisting of about 1 µg, about 2 µg, about 4 µg, about 6 µg, about 8 µg and about 10 µg doses. Multivalent compositions include compositions of the invention that have at least three fusion proteins, such as a composition that includes two fusion proteins having influenza A antigens and one or two fusion proteins having influenza B antigens. The fusion protein of the composition administered to the subject can be in a dose of at least one member selected from the group consisting of about 1 µg, about 2 µg, about 3 µg, about 4 µg, about 5 µg, about 6 µg, about 7 µg, about 8 µg, about 9 µg, about 10 µg dose, about 15 µg dose, about 20 µg dose, about 25 µg dose, about 30 µg dose, about 35 µg dose, about 40 µg dose, about 45 µg dose and about 50 µg dose.

In still another embodiment, the invention is a method of stimulating an immune response to influenza A and influenza B antigens in a subject. The method includes the step of administering to the subject a composition that includes SEQ ID NOs: 268, 269, 126, and 158.

The methods of the invention can further include the administration of an adjuvant.

"Stimulating an immune response," as used herein, refers to the generation of antibodies and/or T-cells to the antigen fused to a loop of domain 3 of flagellin, such as the protein portions of influenza B hemagglutinin (HA) (e.g., HA1-1, HA1-2, HA1-1L proteins) described herein. Stimulating an immune response in a subject can include the production of humoral and/or cellular immune responses that are reactive against the antigen, such as a viral protein, in particular, an influenza viral protein.

The compositions of the invention for use in methods to stimulate immune responses in subjects, can be evaluated for the ability to stimulate an immune response in a subject using well-established methods. Exemplary methods to determine whether the compositions of the invention stimulate an immune response in a subject, include measuring the production of antibodies specific to the antigen (e.g., IgG antibodies) by a suitable technique such as, ELISA assays; the potential to induce antibody-dependent enhancement (ADE) of a secondary infection; macrophage-like assays; neutralization assessed by using the Plaque Reduction Neutralization Test ($PRNT_{80}$); and the ability to generate serum antibodies in non-human models (e.g., mice, rabbits, monkeys) (Putnak, et al., *Vaccine* 23:4442-4452 (2005)).

"Stimulates a protective immune response," as used herein, means administration of the compositions of the invention that include a fusion protein comprising, for example, an influenza B antigen fused to at least one loop of domain 3 of flagellin that result in production of antibodies to the protein to thereby cause a subject to survive challenge by an otherwise lethal dose of a viral protein, such as influenza B viral challenge. Techniques to determine a lethal dose of a virus (e.g., an influenza B virus) are known to one of skill in the art (see, for example, WHO/CDS/CSR/NCS2002.5 "WHO Manual on Animal Influenza Diagnosis and Surveillance" World Health Organization, Dept of Communicable Disease Surveillance and Response, WHO Global Influenza Programme; Harmon, M. W., et al., *J. Clin. Microbiol.* 26:333-337 (1988); Reed, L. J., et al., *Am. J. Hyg.* 27:493-497 (1938); Rose, T., et al., *J. Clin. Microbiol.* 37:937-943 (1999); Walls, H. H. et al., *J. Clin. Microbiol.* 23:240-245 (1986); Current Protocols in Immunology, 19.11.1-19.11.32, Cottey, R., et al., John Wiley & Sons, Inc (2001)). Exemplary techniques for determining a lethal dose can include administration of varying doses of virus and a determination of the percent of subjects that survive following administration of the dose of virus (e.g., $LD_{10}$, $LD_{20}$, $LD_{40}$, $LD_{50}$, $LD_{60}$, $LD_{70}$, $LD_{80}$, $LD_{90}$). For example, a lethal dose of a virus that results in the death of 50% of a population of subjects is referred to as an "$LD_{50}$"; a lethal dose of a virus that results in the death of 80% of a population of subjects is referred to herein as "$LD_{80}$"; a lethal dose of a virus that results in death of 90% of a population of subjects is referred to herein as "$LD_{90}$."

For example, determination of the $LD_{90}$ can be conducted in subjects (e.g., mice) by administering intranasally varying doses (e.g., dilutions, such as log and half-log dilutions of $8 \times 10^3$ egg-infectious doses (EID)) followed by an assessment of the survival of the subjects about 14 days to about 21 days after infection with the virus. Protective immunity can be assessed by physical appearance of the subject, general demeanor (active), weight (initial loss of weight followed by return to a weight about the weight of the subject prior to infection with the virus) and survival after about 14 to about 21 days following infection with the virus.

Assessment of stimulation of protective immunity can also be made by employing assays that assess the ability of the antibodies produced in response to the compositions of the invention (e.g., an antigen, such as an influenza B viral antigen, such as a portion of hemagglutinin) to neutralize binding of the viral protein (e.g., hemagglutinin protein) to a host cell (see, for example, Current Protocols in Immunonology, 19.11.1-19.11.32, Cottey, R., et al., John Wiley & Sons, Inc (2001)). Assessment of stimulation of protective immunity can also be made by employing assays that measure the ability of antibodies to inhibit hemagglutinin binding (see, for example, Burnett, F. M., et al., *J. exp. Biol. Med. Sci.* 25:227-233 (1947); Salk, J. E. *J. Immunol.* 49:87-98 (1944); Current Protocols in Immunology, 19.11.1-19.11.32, Cottey, R., et al., John Wiley & Sons, Inc (2001)).

It is believed that inhibition of hemagglutinin binding is indicative of the ability of antibodies, formed from the compositions and by the methods of the invention, to neutralize the sialic acid binding sites of the naturally occurring viral hemagglutinin ("neutralization of HA binding") and, thereby, prevent infection of the host cell as a consequence of stimulating a protective immune response. Inhibition or neutralization of hemagglutinin binding is believed to correlate with an ability of an immune response to protect against a lethal dose of virus.

Neutralization of HA binding can be assessed by in vitro assays (See, for example, Current Protocols in Immunology 19.11.1-19.11.32, Cottey, R., et al., *Suppl.* 42, John Wiley & Sons, Inc. (2001) and WHO Manual on Animal Influenza Diagnosis and Surveillance, Webster, R., et al., pages 28-36, 48-54, 82-92 (2002)). Exemplary viral neutralization assays rely on the ability of serum to specifically bind and prevent replication of influenza virus in culture, such as in the Madin-Darby Canine Kidney (MDCK) cell line. Briefly, cells are cultured in 96 well plates in the presence of a previously titered virus and the cytopathic effect of the replicating virus is observed under a microscope. To test serum, serial dilutions of the serum are prepared and preincubated with the viral stock for about 2 hours at 37° C. prior to infecting the MDCK cells. The mixture is incubated for an additional 2 hours after which the virus/serum mixture is removed and replaced with fresh media. The cells are grown for 4 days. Wells are scored as positive for viral growth if at least about 50% of the cells are dead in at least about half of the wells for a given serum dilution. The reciprocal of the highest dilution of serum which protects at least about half of the cells from death, in at least about half of the wells, is considered the neutralization titer.

Alternatively, a micro-neutralization in vitro assay can be performed to assess neutralization of HA binding. For example, serum is diluted and preincubated with a known titer of virus and mixed with MDCK cells, as described above. After 2 days of incubation, cells are washed and fixed with acetone. The plates are developed as an ELISA using a monoclonal antibody to the influenza nuclear antigen NP. A micro-neutralization titer is determined as the reciprocal of the highest dilution which yields less than about 50% of the anti-NP reading of the virus-only control wells.

The Hemagglutination Inhibition (HAI) assay is based on the HA antigen on the surface of the influenza virus agglutinating red blood cells (RBC) and preventing red blood cells from precipitating. Antibodies that specifically bind the sialic acid-binding regions of HA prevent agglutination allowing precipitation. The assay is performed in 96 well V bottom plates with fresh chicken RBC. A stock of viral antigen is titered so that about a 4-fold excess of antigen is present relative to the minimum amount needed to prevent precipitation. The test serum, which can be from several species including mouse, ferret, poultry or human, is heated to about 56° C. to inactivate complement. Serial 2-fold dilutions of the inactivated serum are performed and mixed with the stock HA. After about 30 minutes at room temperature, the RBCs are added and the plate is incubated for about 30 to about 45 minutes. Results are scored by observations: agglutination results in cloudy wells while inhibition results in a "button" of red cells precipitated at the bottom of the well. Controls include RBC with no HA, which forms a button, and HA and RBC with no serum, which remains cloudy. The HAI titer of a particular serum sample is the reciprocal of the last dilution which prevents agglutination (i.e., forms a button). For example, if about a 1:128 dilution reads as a button but the 1:256 dilution does not, the HAI titer is about 128.

Fusion proteins of the invention can be made employing routine molecular biological techniques, as described herein. Host cells can be transfected with nucleic acids encoding fusion proteins of the invention. The host cells can be eukaryotic or prokaryotic host cells. Suitable prokaryotic host cells include *E. coli, B. subtilis* and *Pseudomonas fluorescens.*

The eukaryotic host cells employed in the methods of the invention can include a *Saccharomyces* eukaryotic host cell, an insect eukaryotic host cell (e.g., at least one member selected from the group consisting of a Baculovirus infected insect cell, such as *Spodoptera frugiperda* (Sf9) or *Trichhoplusia ni* (High5) cells; and a *Drosophila* insect cell, such as Dme12 cells), a fungal eukaryotic host cell, a parasite eukaryotic host cell (e.g., a *Leishmania tarentolae* eukaryotic host cell), CHO cells, yeast cells (e.g., *Pichia*) and a *Kluyveromyces lactis* host cell.

Suitable eukaryotic host cells and vectors can also include plant cells (e.g., tomato; chloroplast; mono- and dicotyledonous plant cells; *Arabidopsis thaliana; Hordeum vulgare; Zea mays*; potato, such as *Solanum tuberosum*; carrot, such as *Daucus carona* L.; and tobacco, such as *Nicotiana tabacum, Nicotiana benthamiana* (Gils, M., et al., *Plant Biotechnol J.* 3:613-20 (2005); He, D. M., et al., *Colloids Surf B Biointerfaces,* (2006); Huang, Z., et al., *Vaccine* 19:2163-71 (2001); Khandelwal, A., et al., *Virology.* 308:207-15 (2003); Marquet-Blouin, E., et al., *Plant Mol Biol* 51:459-69 (2003); Sudarshana, M. R., et al. *Plant Biotechnol J.* 4:551-9 (2006); Varsani, A., et al., *Virus Res,* 120:91-6 (2006); Kamarajugadda S., et al., *Expert Rev Vaccines* 5:839-49 (2006); Koya V, et al., *Infect Immun.* 73:8266-74 (2005); Zhang, X., et al., *Plant Biotechnol J.* 4:419-32 (2006)).

The fusion proteins of the invention can be purified and characterized employing well-known methods (e.g., gel chromatography, cation exchange chromatography, SDS-PAGE), as described herein.

For large scale production, fermentation techniques can be employed. Exemplary fermentation techniques can include a proposed cycle that can start with a culture inoculated into 6 L of MRBR media, as described herein, held at about 30° C., about pH 7, and DO controlled to greater than about 30%. A 6 liter feed can then be started at least about 30 minutes after glucose exhaustion. The proposed 6 liter feed media, when combined with 6 L of MRBR media, can provide the necessary conditions for *E. coli* growth based on about 52% utilization of carbon for growth. The feed may or may not include IPTG. The batch can be induced with at least 2 mM IPTG, introduced as a bolus, shortly after the feed is started to initiate production. The feed rate can start at about 20 mL feed per hour per liter bioreactor volume and increase over time based on the ability of the culture to accept more glucose without glucose accumulation. The culture can be harvested when the feed is complete. The 6 liter feed media, about pH 6.0, can include Glucose 180 g/L; $KH_2PO_4$ 2 g/L; $NaH_2PO_4$ ($H_2O$) 4 g/L; $(NH_4)_2HPO_4$ 12 g/L; $(NH_4)_2HSO_4$ 4 g/L; DL-Alanine 40 g/L; Citric Acid 4 g/L; $MgSO_4(7H_2O)$ 5.5 g/L; Trace Metals 6 mL; $CaCl_2$ 2.5 g/L; $FeSO_4$ $7H_2O$ 1 g/L.

Cell disruption and clarification in a large scale production can include removal of Triton X-100 from the resuspension buffer; dissolution of insolubles by the addition of 50 mM Tris, 25 mM NaCl, 8 M urea, about pH 8 to the lysate; addition of PEI (polyethylamine) and subsequent removal by centrifugation with one or more of the buffers to remove nucleic acids and/or aid in filtration; the addition of flocullants, such as AEROSIL 380, AEROSIL 200, ALKOXIDE ALU C, and CELPUR; and subsequent removal by centrifugation to aid in filtration. Cation exchange chromatography can include the use of a process resin, adding a denaturing endotoxin removal step containing up to 8 M urea and up to about 2% Triton X-100, and a step gradient elution. The step elution gradient can include about 100 to about 200 mM NaCl.

In an additional embodiment, the invention includes a protein, polypeptide or peptide having at least about 70%, at least about 75%, at least about 80%, at least about 85%, at least about 90%, at least about 95%, at least about 98% and at least about 99% sequence identity to the proteins, polypeptides and peptides of the invention.

The percent identity of two amino acid sequences (or two nucleic acid sequences) can be determined by aligning the sequences for optimal comparison purposes (e.g., gaps can be introduced in the sequence of a first sequence). The amino acid sequence or nucleic acid sequences at corresponding positions are then compared, and the percent identity between the two sequences is a function of the number of identical positions shared by the sequences (i.e., % identity=# of identical positions/total # of positions×100). The length of the protein or nucleic acid encoding can be aligned for comparison purposes is at least about 70%, at least about 75%, at least about 80%, at least about 85%, at least about 90%, at least about 95%, at least about 98%, at least about 99% of the length of the reference sequence, for example, the nucleic acid sequence of a flagellin, including a nucleic acid sequence that encodes an R3 construct (e.g., SEQ ID NO: 283) or an R32x construct (e.g., SEQ ID NO: 284, 285), flagellin (SEQ ID NOs: 2, 127), antigen (e.g., SEQ ID NOs: 50, 51, 52, 98 and 287) employed in the fusion proteins of the invention of a fusion protein of the invention and fusion proteins of the invention (e.g., SEQ ID NOs:126, 158, 268 and 269).

The actual comparison of the two sequences can be accomplished by well-known methods, for example, using a mathematical algorithm. A preferred, non-limiting example of such a mathematical algorithm is described in Karlin et al. (*Proc. Natl. Acad. Sci. USA*, 90:5873-5877 (1993), the teachings of which are hereby incorporated by reference in its entirety). Such an algorithm is incorporated into the BLASTN and BLASTX programs as described, for example, in Schaffer et al. (*Nucleic Acids Res.*, 29:2994-3005 (2001) and Oehmen, C. S. et al., *Bioinformatics* 29 (6): 797-798 (2013). When utilizing BLAST and Gapped BLAST programs, the default parameters of the respective programs (e.g., BLASTN; available at the Internet site for the National Center for Biotechnology Information) can be used. In one embodiment, the database searched is a non-redundant (NR) database, and parameters for sequence comparison can be set at: no filters; Expect value of 10; Word Size of 3; the Matrix is BLOSUM62; and Gap Costs have an Existence of 11 and an Extension of 1.

Another mathematical algorithm employed for the comparison of sequences is the algorithm of Myers and Miller, CABIOS (1989). Such an algorithm is incorporated into the ALIGN program (version 2.0), which is part of the GCG (Accelrys, San Diego, Calif.) sequence alignment software package. When utilizing the ALIGN program for comparing amino acid sequences, a PAM120 weight residue table, a gap length penalty of 12, and a gap penalty of 4 is used. Additional algorithms for sequence analysis are known in the art and include ADVANCE and ADAM as described in Torellis, et al., *Comput. Appl. Biosci.*, 10: 3-5 (1994) and FASTA described in Pearson, et al., (*Proc. Natl. Acad. Sci. USA*, 85: 2444-2448 (1988), the teachings of which are hereby incorporated by reference in its entirety).

The percent identity between two amino acid sequences can also be accomplished using the GAP program in the GCG software package (Accelrys, San Diego, Calif.) using either a Blossom 63 matrix or a PAM250 matrix, and a gap weight of 12, 10, 8, 6, or 4 and a length weight of 2, 3, or 4. In yet another embodiment, the percent identity between two nucleic acid sequences can be accomplished using the GAP program in the GCG software package (Accelrys, San Diego, Calif.), using a gap weight of 50 and a length weight of 3.

The nucleic acid sequence encoding a protein portion of HA, polypeptide or fusion proteins of the invention and polypeptides of the invention can include nucleic acid sequences that hybridize to nucleic acid sequences or complements of nucleic acid sequences of the invention, for example, the nucleic acid sequence of a flagellin, including an R3 construct or an R32x construct, antigen employed in the fusion proteins of the invention of a fusion protein of the invention under selective hybridization conditions (e.g., highly stringent hybridization conditions). As used herein, the terms "hybridizes under low stringency," "hybridizes under medium stringency," "hybridizes under high stringency," or "hybridizes under very high stringency conditions," describe conditions for hybridization and washing of the nucleic acid sequences. Guidance for performing hybridization reactions, which can include aqueous and nonaqueous methods, can be found in Aubusel, F. M., et al., Current Protocols in Molecular Biology, John Wiley & Sons, N.Y. (2001).

For applications that require high selectivity, relatively high stringency conditions to form hybrids can be employed. In solutions used for some membrane based hybridizations, addition of an organic solvent, such as formamide, allows the reaction to occur at a lower temperature. High stringency conditions are, for example, relatively low salt and/or high temperature conditions. High stringency are provided by about 0.02 M to about 0.10 M NaCl at temperatures of about 50° C. to about 70° C. High stringency conditions allow for limited numbers of mismatches between the two sequences. In order to achieve less stringent conditions, the salt concentration may be increased and/or the temperature may be decreased. Medium stringency conditions are achieved at a salt concentration of about 0.1 to 0.25 M NaCl and a temperature of about 37° C. to about 55° C., while low stringency conditions are achieved at a salt concentration of about 0.15 M to about 0.9 M NaCl, and a temperature ranging from about 20° C. to about 55° C. Selection of components and conditions for hybridization are well known to those skilled in the art and are reviewed in Ausubel et al., Short Protocols in Molecular Biology, John Wiley & Sons, New York N.Y., Units 2.8-2.11, 3.18-3.19 and 4-64.9, (1997).

A "subject," as used herein, can be a mammal, such as a primate or rodent (e.g., rat, mouse). In a particular embodiment, the subject is a human.

An "effective amount," when referring to the amount of a composition and fusion protein of the invention, refers to that amount or dose of the composition and fusion protein, that, when administered to the subject is an amount sufficient for therapeutic efficacy (e.g., an amount sufficient to stimulate an immune response in the subject). The compositions and fusion proteins of the invention can be administered in a single dose or in multiple doses.

The methods of the present invention can be accomplished by the administration of the compositions and fusion proteins of the invention by enteral or parenteral means. Specifically, the route of administration is by oral ingestion (e.g., drink, tablet, capsule form) or intramuscular injection of the composition and fusion protein. Other routes of administration as also encompassed by the present invention including intravenous, intradermal, intraarterial, intraperitoneal, or subcutaneous routes, and nasal administration. Suppositories or transdermal patches can also be employed.

The compositions and fusion proteins of the invention can be administered ex vivo to a subject's autologous dendritic cells. Following exposure of the dendritic cells to the composition and fusion protein of the invention, the dendritic cells can be administered to the subject.

The compositions and fusion proteins of the invention can be administered alone or can be coadministered to the patient. Coadministration is meant to include simultaneous or sequential administration of the composition, fusion protein or polypeptide of the invention individually or in combination. Where the composition and fusion protein are administered individually, the mode of administration can be conducted sufficiently close in time to each other (for example, administration of the composition close in time to administration of the fusion protein) so that the effects on stimulating an immune response in a subject are maximal. It is also envisioned that multiple routes of administration (e.g., intramuscular, oral, transdermal) can be used to administer the compositions and fusion proteins of the invention.

The compositions and fusion proteins of the invention can be administered alone or as admixtures with conventional excipients, for example, pharmaceutically, or physiologically, acceptable organic, or inorganic carrier substances suitable for enteral or parenteral application which do not deleteriously react with the extract. Suitable pharmaceutically acceptable carriers include water, salt solutions (such as Ringer's solution), alcohols, oils, gelatins and carbohydrates such as lactose, amylose or starch, fatty acid esters, hydroxymethycellulose, and polyvinyl pyrrolidine. Such preparations can be sterilized and, if desired, mixed with auxiliary agents such as lubricants, preservatives, stabilizers, wetting agents, emulsifiers, salts for influencing osmotic pressure, buffers, coloring, and/or aromatic substances and the like which do not deleteriously react with the compositions, fusion proteins or polypeptides of the invention. The preparations can also be combined, when desired, with other active substances to reduce metabolic degradation. The compositions and fusion proteins of the invention can be administered by is oral administration, such as a drink, intramuscular or intraperitoneal injection or intranasal delivery. The compositions and fusion proteins alone, or when combined with an admixture, can be administered in a single or in more than one dose over a period of time to confer the desired effect (e.g., alleviate prevent viral infection, to alleviate symptoms of virus infection, such as influenza or flaviviral infection).

When parenteral application is needed or desired, particularly suitable admixtures for the compositions and fusion proteins are injectable, sterile solutions, preferably oily or aqueous solutions, as well as suspensions, emulsions, or implants, including suppositories. In particular, carriers for parenteral administration include aqueous solutions of dextrose, saline, pure water, ethanol, glycerol, propylene glycol, peanut oil, sesame oil, polyoxyethylene-block polymers, and the like. Ampules are convenient unit dosages. The compositions, fusion proteins or polypeptides can also be incorporated into liposomes or administered via transdermal pumps or patches. Pharmaceutical admixtures suitable for use in the present invention are well-known to those of skill in the art and are described, for example, in Pharmaceutical Sciences (17th Ed., Mack Pub. Co., Easton, Pa.) and WO 96/05309 the teachings of which are hereby incorporated by reference.

The compositions and fusion proteins of the invention can be administered to a subject on a support that presents the compositions, fusion proteins and polypeptides of the invention to the immune system of the subject to generate an immune response in the subject. The presentation of the compositions, fusion proteins and polypeptides of the invention would preferably include exposure of antigenic portions of the viral protein to generate antibodies. The fusion proteins of the invention are in close physical proximity to one another on the support. The fusion proteins of the invention can be attached to the support by covalent or noncovalent attachment. Preferably, the support is biocompatible. "Biocompatible," as used herein, means that the support does not generate an immune response in the subject (e.g., the production of antibodies). The support can be a biodegradable substrate carrier, such as a polymer bead or a liposome. The support can further include alum or other suitable adjuvants. The support can be a virus (e.g., adenovirus, poxvirus, alphavirus), bacteria (e.g., *Salmonella*) or a nucleic acid (e.g., plasmid DNA, CpG).

The dosage and frequency (single or multiple doses) administered to a subject can vary depending upon a variety of factors, including prior exposure to an antigen, a viral protein, the duration of viral infection, prior treatment of the viral infection, the route of administration of the composition or fusion protein; size, age, sex, health, body weight, body mass index, and diet of the subject; nature and extent of symptoms of viral exposure, viral infection and the particular viral responsible for the infection (e.g., influenza virus), or treatment or infection of an other antigen, such as an influenza antigen, kind of concurrent treatment, complications from the viral exposure, viral infection or exposure or other health-related problems. Other therapeutic regimens or agents can be used in conjunction with the methods and compositions and fusion proteins of the present invention. For example, the administration of the compositions and fusion proteins can be accompanied by other viral therapeutics or use of agents to treat the symptoms of a condition associated with or consequent to exposure to the antigen, such as influenza infection. Adjustment and manipulation of established dosages (e.g., frequency and duration) are well within the ability of those skilled in the art.

Exemplary portions of antigens, flagellin and fusion proteins of the invention include those listed in Table 1.

TABLE 1

| Fusion Protein | HA Strain Name/Format | Insertion Site | Portion of HA | SEQ ID NO |
|---|---|---|---|---|
| HL772 | B/Wisconsin/1/2010 D3I-o1 | 276-277 in SEQ ID NO: 127 | HA1-2 extension, SEQ ID NO: 50 | 126 |
| HL657 | B/Brisbane/60/2008 D3I-o1 | 276-277 in SEQ ID NO: 127 | HA1-2, SEQ ID NO: 48 | 128 |
| HL775 | A/Perth/16/2009 D3I-o1 | 276-277 in SEQ ID NO: 127 | HA1-1L modified, SEQ ID NO: 228 | 129 |
| HL1018 | A/Anhui/1/2013 D3I-o1 | 276-277 in SEQ ID NO: 127 | HA1-2, SEQ ID NO: 110 | 130 |

TABLE 1-continued

| Fusion Protein | HA Strain Name/Format | Insertion Site | Portion of HA | SEQ ID NO |
|---|---|---|---|---|
| HL656 | B/Florida/4/2006 D3I-o1 | 276-277 in SEQ ID NO: 127 | HA1-2 extension, SEQ ID NO: 50 | 151 |
| HL774 | B/Hong Kong/259/2010 D3I-o1 | 276-277 in SEQ ID NO: 127 | HA1-2 extension, SEQ ID NO: 54 | 157 |
| HL787 | B/Bangladesh/5495/2009 D3I-o1 | 276-277 in SEQ ID NO: 127 | HA1-2 extension, SEQ ID NO: 52 | 158 |
| HL849 | B/Wisconsin/1/2010 D3I-i1 | 259-260 in SEQ ID NO: 2 | HA1-2 extension, SEQ ID NO: 50 | 159 |
| HL848 | B/Wisconsin/1/2010 D3I-s1 | 244-245 in SEQ ID NO: 2 | HA1-2 extension, SEQ ID NO: 50 | 160 |
| HL825 | B/Wisconsin/1/2010 D2I-o1 | 187-188 in SEQ ID NO: 2 | HA1-2 extension, SEQ ID NO: 50 | 161 |
| HL826 | B/Wisconsin/1/2010 D2I-o2 | 178-179 in SEQ ID NO: 2 | HA1-2 extension, SEQ ID NO: 50 | 162 |
| HL827 | B/Wisconsin/1/2010 D2I-o3 | 326-327 in SEQ ID NO: 2 | HA1-2 extension, SEQ ID NO: 50 | 163 |
| HL828 | B/Wisconsin/1/2010 D1I-o1 | 102-103 in SEQ ID NO: 2 | HA1-2 extension, SEQ ID NO: 50 | 164 |
| HL850 | B/Wisconsin/1/2010 D2I-i1 | 366-367 in SEQ ID NO: 2 | HA1-2 extension, SEQ ID NO: 50 | 165 |
| HL733 | B/Brisbane/60/2008 D2I-o1 | 187-188 in SEQ ID NO: 270 | HA1-2 extension, SEQ ID NO: 48 | 166 |
| HL856 | B/Brisbane/60/2008 D2I-o1 | 187-188 in SEQ ID NO: 2 | HA1-2 extension, SEQ ID NO: 48 | 167 |
| HL857 | B/Brisbane/60/2008 D2I-o2 | 178-179 in SEQ ID NO: 2 | HA1-2 extension, SEQ ID NO: 48 | 168 |
| HL888 | B/Wisconsin/1/2010 D3I-o2 | 230-231 in SEQ ID NO: 2 | HA1-2 extension, SEQ ID NO: 50 | 169 |
| HL890 | B/Wisconsin/1/2010 D2I-c1 | 308-309 in SEQ ID NO: 2 | HA1-2 extension, SEQ ID NO: 50 | 170 |
| HL892 | B/Wisconsin/1/2010 D2I-i2 | 388-389 in SEQ ID NO: 2 | HA1-2 extension, SEQ ID NO: 50 | 171 |
| HL858 | B/Brisbane/60/2008 D2I-o3, | 326-327 in SEQ ID NO: 2 | HA1-2 extension, SEQ ID NO: 48 | 172 |
| HL860 | B/Brisbane/60/2008 D3I-s1, | 244-245 in SEQ ID NO: 2 | HA1-2 extension, SEQ ID NO: 48 | 173 |
| HL889 | B/Brisbane/60/2008 D3I-o2, | 230-231 in SEQ ID NO: 2 | HA1-2 extension, SEQ ID NO: 48 | 174 |
| HL891 | B/Brisbane/60/2008 D2I-c1 | 308-309 in SEQ ID NO: 2, | HA1-2 extension, SEQ ID NO: 48 | 175 |
| HL893 | B/Brisbane/60/2008 D2I-i2 | 388-389 in SEQ ID NO: 2 | HA1-2 extension, SEQ ID NO: 48 | 176 |
| HL864 | B/Wisconsin/1/2010 D3I-o1 | 276-277 in SEQ ID NO: 178 | HA1-2 extension, SEQ ID NO: 50 | 177 |
| HL854 | B/Wisconsin/1/2010 R3 | 198-199 in SEQ ID NO: 271 | HA1-2 extension, SEQ ID NO: 50 | 179 |
| HL861 | B/Brisbane/60/2008 D3I-i1 | 259-260 in SEQ ID NO: 2 | HA1-2 extension, SEQ ID NO: 48 | 180 |
| HL862 | B/Brisbane/60/2008 D2I-i1 | 366-367 in SEQ ID NO: 2 | HA1-2 extension, SEQ ID NO: 48 | 181 |
| HL863 | B/Sichuan/379/1999 D3I-o1 | 276-277 in SEQ ID NO: 127 | HA1-2 extension, SEQ ID NO: 56 | 182 |
| HL903 | B/Sichuan/379/1999 D3I-i1 | 259-260 in SEQ ID NO: 2 | HA1-2 extension, SEQ ID NO: 56 | 183 |
| HL869 | B/Hubei-Wujiagang/158/2009 D3I-o1 | 276-277 in SEQ ID NO: 127 | HA1-2 extension, SEQ ID NO: 58 | 184 |
| HL871 | B/Texas/6/2011 D3I-o1 | 276-277 in SEQ ID NO: 127 | HA1-2 extension, SEQ ID NO: 60 | 185 |
| HL639 | A/Perth/16/2009 D3I-o1 | 276-277 in SEQ ID NO: 127 | HA1-1L, SEQ ID NO: 98 | 186 |
| HL836 | A/Victoria/361/2011 D3I-o1 | 276-277 in SEQ ID NO: 127 | HA1-1L, SEQ ID NO: 98 | 187 |
| HL982 | A/Anhui/1/2005 D3I-o1 | 276-277 in SEQ ID NO: 127 | HA1-1L, SEQ ID NO: 104 | 188 |
| HL960 | A/Indonesia/5/2005 D3I-o1 | 276-278 in SEQ ID NO: 127 | HA1-1L, SEQ ID NO: 106 | 189 |
| HL876 | A/New York/107/2003 D3I-o1 | 276-277 in SEQ ID NO: 127 | HA1-1L, SEQ ID NO: 112 | 190 |
| HL926 | A/Canada/Rv504/2004 D3I-o1 | 276-277 in SEQ ID NO: 127 | HA1-1L, SEQ ID NO: 114 | 191 |
| HL880 | A/Netherlands/219/03 D3I-o1 | 276-277 in SEQ ID NO: 127 | HA1-1L, SEQ ID NO: 115 | 192 |
| HL958 | B/Hong Kong/259/2010 D3I-o1 | 276-277 in SEQ ID NO: 127 | HA1-2 extension, SEQ ID NO: 54 | 193 |

Additional portions of antigens, flagellin and fusion proteins for use of the invention can include those listed in Table 2. For example, the fusion protein can include a portion of the globular head of HA fused to loop 6 of domain 3 of *S. typhimuium* FljB flagellin at the D3I-o1 insertion site between residues 276-277 in SEQ ID NO: 127.

TABLE 2

| HA Strain Name | Format | Portion of HA | SEQ ID NO |
|---|---|---|---|
| A/Perth/16/2009 | D3I-o1 | HA1-2, SEQ ID NO: 64 | 194 |
| A/Perth/16/2009 | D3I-o1 | HA1-1, SEQ ID NO: 11 | 195 |
| A/Wyoming/03/2003 | D3I-o1 | HA1-2, SEQ ID NO: 65 | 196 |
| A/Wyoming/03/2003 | STF2.D3Ins.HA1-1 WY03 D3I-o1 | HA1-1, SEQ ID NO: 12 | 197 |
| A/Wyoming/03/2003 | D3I-o1 | HA1-1L, SEQ ID NO: 99 | 198 |
| A/New York/2782/2004 | STF2.D3Ins.HA1-2 NY2782 D3I-o1 | HA1-2, SEQ ID NO: 66 | 199 |
| A/New York/2782/2004 | STF2.D3Ins.HA1-1 NY2782 D3I-o1 | HA1-1, SEQ ID NO: 13 | 200 |
| A/New York/2782/2004 | D3I-o1 | HA1-1L, SEQ ID NO: 100 | 201 |
| A/Victoria/361/2011 | STF2.D3Ins.HA1-2 VT361 D3I-o1 | HA1-2, SEQ ID NO: 67 | 202 |
| A/Victoria/361/2011 | STF2.D3Ins.HA1-1 VT361 D3I-o1 | HA1-1, SEQ ID NO: 14 | 203 |
| A/Aichi/2/68 | STF2.D3Ins.HA1-2 Aichi2 D3I-o1 | HA1-2, SEQ ID NO: 68 | 204 |
| A/Aichi/2/68 | STF2.D3Ins.HA1-1 Aichi2 D3I-o1 | HA1-1, SEQ ID NO: 15 | 205 |
| A/Aichi/2/68 | D3I-o1 | HA1-1L, SEQ ID NO: 102 | 206 |
| A/Wisconsin/67/2005 | STF2.D3Ins.HA1-2 WI67 D3I-o1 | HA1-2, SEQ ID NO: 69 | 207 |
| A/Wisconsin/67/2005 | STF2.D3Ins.HA1-WI67 D3I-o1 | HA1-1, SEQ ID NO: 16 | 208 |
| A/Wisconsin/67/2005 | STF2.D3Ins.HA1-1L WI67 D3I-o1 | HA1-1L, SEQ ID NO: 103 | 209 |
| A/Anhui/1/2005 | STF2.D3Ins.HA1-2 AH1 D3I-o1 | HA1-2, SEQ ID NO: 70 | 210 |
| A/Anhui/1/2005 | STF2.D3Ins.HA1-1 AH1 D3I-o1 | HA1-1, SEQ ID NO: 17 | 211 |
| A/Bar headed goose/Qinghai/1A/2005 | STF2.D3Ins.HA1-2 QH1A D3I-o1 | HA1-2, SEQ ID NO: 71 | 212 |
| A/Bar headed goose/Qinghai/1A/2005 | STF2.D3Ins.HA1-1 QH1A D3I-o1 | HA1-1, SEQ ID NO: 18 | 213 |
| A/Bar headed goose/Qinghai/1A/2005 | STF2.D3Ins.HA1-1L QH1A D3I-o1 | HA1-1L, SEQ ID NO: 105 | 214 |
| A/Indonesia/5/2005 | STF2.D3Ins.HA1-2 IND5 D3I-o1 | HA1-2, SEQ ID NO: 72 | 215 |
| A/Indonesia/5/2005 | STF2.D3Ins.HA1-1 IND5 D3I-o1 | HA1-1, SEQ ID NO: 19 | 216 |
| A/Vietnam/1203/2004 | STF2.D3Ins.HA1-2 VN1203 D3I-o1 | HA1-2, SEQ ID NO: 80 | 217 |
| A/Vietnam/1203/2004 | STF2.D3Ins.HA1-1 VN1203 D3I-o1 | HA1-1, SEQ ID NO: 20 | 218 |
| A/Vietnam/1203/2004 | STF2.D3Ins.HA1-1L VN1203 D3I-o1 | HA1-1L, SEQ ID NO: 107 | 219 |
| A/Hubei/1/2010 | STF2.D3Ins.HA1-2 HB1 D3I-o1 | HA1-2, SEQ ID NO: 73 | 220 |

TABLE 2-continued

| HA Strain Name | Format | Portion of HA | SEQ ID NO |
|---|---|---|---|
| A/Hubei/1/2010 | STF2.D3Ins.HA1-1 HB1 D3I-o1 | HA1-1, SEQ ID NO: 21 | 221 |
| A/Hubei/1/2010 | STF2.D3Ins.HA1-1L HB1 D3I-o1 | HA1-1L, SEQ ID NO: 108 | 222 |
| A/Hong Kong/156/97 | STF2.D3Ins.HA1-2 HK156 D3I-o1 | HA1-2, SEQ ID NO: 74 | 223 |
| A/Hong Kong/156/97 | STF2.D3Ins.HA1-1 HK156 D3I-o1 | HA1-1, SEQ ID NO: 22 | 224 |
| A/Hong Kong/156/97 | STF2.D3Ins.HA1-1L HK156 D3I-o1 | HA1-1L, SEQ ID NO: 109 | 225 |
| A/Anhui/1/2013 | STF2.D3Ins.HA1-2 AH1 D3I-o1 | HA1-2, SEQ ID NO: 75 | 226 |
| A/Anhui/1/2013 | STF2.D3Ins.HA1-1 AH1 D3I-o1 | HA1-1, SEQ ID NO: 23 | 227 |
| A/Anhui/1/2013 | STF2.D3Ins.HA1-1L AH1 D3I-o1 | HA1-1L, SEQ ID NO: 110 | 228 |
| A/Turkey/Italy/214845/2002 | STF2.D3Ins.HA1-2 IT214845 D3I-o1 | HA1-2, SEQ ID NO: 76 | 229 |
| A/Turkey/Italy/214845/2002 | STF2.D3Ins.HA1-1 IT214845 D3I-o1 | HA1-1, SEQ ID NO: 24 | 230 |
| A/Turkey/Italy/214845/2002 | STF2.D3Ins.HA1-1L IT214845 D3I-o1 | HA1-1L, SEQ ID NO: 111 | 231 |
| A/New York/107/2003 | STF2.D3Ins.HA1-2 NY107 D3I-o1 | HA1-2, SEQ ID NO: 77 | 232 |
| A/New York/107/2003 | STF2.D3Ins.HA1-1 NY107 D3I-o1 | HA1-1, SEQ ID NO: 25 | 233 |
| A/Mallard/Netherlands/12/2000 | STF2.D3Ins.HA1-2 NL12 D3I-o1 | HA1-2, SEQ ID NO: 78 | 234 |
| A/Mallard/Netherlands/12/2000 | STF2.D3Ins.HA1-1 NL12 D3I-o1 | HA1-1, SEQ ID NO: 26 | 235 |
| A/Mallard/Netherlands/12/2000 | STF2.D3Ins.HA1-1L NL12 D3I-o1 | HA1-1L, SEQ ID NO: 113 | 236 |
| A/Canada/Rv504/2004 | STF2.D3Ins.HA1-2 CA504 D3I-o1 | HA1-2, SEQ ID NO: 79 | 237 |
| A/Canada/Rv504/2004 | STF2.D3Ins.HA1-1 CA504 D3I-o1 | HA1-1, SEQ ID NO: 27 | 238 |
| A/Netherlands/219/03 | STF2.D3Ins.HA1-2 NL219 D3I-o1 | HA1-2, SEQ ID NO: 81 | 239 |
| A/Netherlands/219/03 | STF2.D3Ins.HA1-1 NL219 D3I-o1 | HA1-1, SEQ ID NO: 28 | 240 |
| A/Hong Kong/33982/2009 | STF2.D3Ins.HA1-2 HK33982 D3I-o1 | HA1-2, SEQ ID NO: 82 | 241 |
| A/Hong Kong/33982/2009 | STF2.D3Ins.HA1-1 HK33982 D3I-o1 | HA1-1, SEQ ID NO: 29 | 242 |
| A/Hong Kong/33982/2009 | STF2.D3Ins.HA1-1L HK33982 D3I-o1 | HA1-1L, SEQ ID NO: 116 | 243 |
| A/Hong Kong/1073/99 | STF2.D3Ins.HA1-2 HK1073 D3I-o1 | HA1-2, SEQ ID NO: 83 | 244 |
| A/Hong Kong/1073/99 | STF2.D3Ins.HA1-1 HK1073 D3I-o1 | HA1-1, SEQ ID NO: 30 | 245 |

TABLE 2-continued

| HA Strain Name | Format | Portion of HA | SEQ ID NO |
|---|---|---|---|
| A/Hong Kong/1073/99 | STF2.D3Ins.HA1-1L HK1073 D3I-o1 | HA1-1L, SEQ ID NO: 117 | 246 |
| A/Chicken/Hong Kong/G9/97 | STF2.D3Ins.HA1-2 HKG9 D3I-o1 | HA1-2, SEQ ID NO: 84 | 247 |
| A/Chicken/Hong Kong/G9/97 | STF2.D3Ins.HA1-1 HKG9 D3I-o1 | HA1-1, SEQ ID NO: 31 | 248 |
| A/Chicken/Hong Kong/G9/97 | STF2.D3Ins.HA1-1L HKG9 D3I-o1 | HA1-1L, SEQ ID NO: 118 | 249 |
| A/chicken/Anhui/AH16/2008 | STF2.D3Ins.HA1-2 AH16 D3I-o1 | HA1-2, SEQ ID NO: 85 | 250 |
| A/chicken/Anhui/AH16/2008 | STF2.D3Ins.HA1-1 AH16 D3I-o1 | HA1-1, SEQ ID NO: 32 | 251 |
| A/chicken/Anhui/AH16/2008 | STF2.D3Ins.HA1-1L AH16 D3I-o1 | HA1-1L, SEQ ID NO: 119 | 252 |
| A/Swine/Hong Kong/9/98 | STF2.D3Ins.HA1-2 HK9 D3I-o1 | HA1-2, SEQ ID NO: 86 | 253 |
| A/Swine/Hong Kong/9/98 | STF2.D3Ins.HA1-1 HK9 D3I-o1 | HA1-1, SEQ ID NO: 33 | 254 |
| A/Swine/Hong Kong/9/98 | STF2.D3Ins.HA1-1L HK9 D3I-o1 | HA1-1L, SEQ ID NO: 120 | 255 |
| A/swine/Guangxi/58/2005 | STF2.D3Ins.HA1-2 GX58 D3I-o1 | HA1-2, SEQ ID NO: 87 | 256 |
| A/swine/Guangxi/58/2005 | STF2.D3Ins.HA1-1 GX58 D3I-o1 | HA1-1, SEQ ID NO: 34 | 257 |
| A/swine/Guangxi/58/2005 | STF2.D3Ins.HA1-1L GX58 D3I-o1 | HA1-1L, SEQ ID NO: 121 | 258 |
| B/Shanghai/361/2002 | STF2.D3Ins.HA1-2 D3I-o1 with extension | HA1-2, SEQ ID NO: 89 | 259 |
| B/Malaysia/2506/2004 | STF2.D3Ins.HA1-2 D3I-o1 with extension | HA1-2, SEQ ID NO: 62 | 260 |
| B/Ohio/1/2005 | STF2.D3Ins.HA1-2 D3I-o1 with extension | HA1-2, SEQ ID NO: 91 | 261 |
| B/Hong Kong/330/2001 | STF2.D3Ins.HA1-2 D3I-o1 with extension | HA1-2, SEQ ID NO: 93 | 262 |

EXEMPLIFICATION

Example 1

Primary Sequence Analysis of Flagellin to Identify Antigen Insertion Sites to Target Influenza B Primary sequence analysis showed that the amino acid sequence of portions of influenza viral hemagglutinin, such as HA1-2 of the Flu B (Influenza B) globular head (SEQ ID NOs: 45, 47 and 61), included a higher content of positively charged residues compared to most influenza A globular head portions, such as SEQ ID NO: 63. At neutral pH, a portion of an influenza Flu B globular head, such as SEQ ID NO: 45, has a net positive charge with a pI of between about 8.5 to about 9.5. At neutral pH, flagellin has a net negative charge due, in part, to a series of negatively charged amino acids in Domain 1 (D1) of flagellin with a pI of about 4.5 to about 5.0. Apposition of a positively charged portion of an influenza B HA with the negatively charged D1 of flagellin, such as in R3 and R3.2x fusion protein, may result in intra-molecular interactions between the portion of HA and portion of flagellin that may interfere with the ability of flagellin to trigger TLR5 signaling and with the presentation of the influenza B HA antigen to immune cell receptors.

Immunogenicity of an R3 fusion protein of composition that includes an influenza B, such as a B/Florida/4/2006 as in HL098 (SEQ ID NO: 122), may be improved by extending the portion of the globular head amino acid sequence by an additional 9 amino acids (SEQ ID NO: 123) at the C-terminus of HA1-2. For example, an additional 9 amino acids of the HA (SLPLIGEAD (SEQ ID NO: 123), which corresponds to native amino acid residues 300-308 of SEQ ID NO: 124, can be added to the carboxy-terminus of HA1-2 (e.g., SEQ ID NO: 45) to generate SEQ ID NO: 46. For example, the HA1-2 with an extension can then be used to generate a fusion protein, such as HL352 (SEQ ID NO: 125). The additional 9 amino acids to the portion of HA (e.g., SEQ ID NO: 123)

introduced two negatively charged amino acids (E306 and D308) to the portion of the globular head, which may serve to "repel" the portion of the globular head away from the negatively charged flagellin. However, as described infra, while improved, the activity (TLR5 activation and immunogenicity) associated with fusion proteins having HA components with the additional 9 amino acids was low, as discussed infra with respect to, for example, FIGS. 3 and 5 and fusion proteins referred to as "HL098" (SEQ ID NO: 122) and "HL352" (SEQ ID NO: 125).

Fusion of an antigen with an isoelectric point greater than about 7.0 to a loop of Domain 3 of flagellin is believed to position the HA antigen component of the fusion protein distant (i.e., away) from domain (D1) (the TLR5-binding domain) of flagellin. Portions of an influenza viral hemagglutinin that include at least a portion of a globular head having at least one β-sheet at the bottom of the globular head and that have an isoelectric point greater than about 7.0, such as an influenza B viral hemagglutinin (e.g., SEQ ID NO: 45, 61), can be fused within at least one loop of domain 3 of flagellin to form a "D3Ins format," also referred to as a "D3I" or "D3I construct." Likewise, portions of an influenza viral hemagglutinin that include at least a portion of a globular head having at least one β-sheet at the bottom of the globular head and that have an isoelectric point greater than about 7.0, such as an influenza A viral hemagglutinin of SEQ ID NO: 98, and A/Perth/16/2009 strains, can be fused within at least one loop of domain 3 of flagellin to form a "D3Ins format." Fusion proteins that include both influenza A and influenza B antigens can be combined to form multivalent compositions that target both influenza A and influenza B antigens to thereby prevent or minimize disease associated with influenza A and influenza B infection.

The crystal structure of domain 3 of *Salmonella typhimurium* flagellin (FliC, Protein Data Bank ID (PDB): 1UCU) has been reported (Yonekura, K., et al., *Nature*, 424: 643-650 (2003)) and includes the identification of 6 loops in domain 3 of SEQ ID NO: 1. Secondary structure prediction of *Salmonella typhimurium* flagellin FliC using PHD is depicted below and, consistent with the known tertiary structure, predicts 6 loops in domain 3. Designations below are AA: Primary amino acid sequence; PROF_sec: Secondary structure prediction where "H" stands for α-Helix and "E" stands for β-strand (Rost, B., et al., *Proteins*, 19: 55-72 (1994)). The predicted loops in domain 3 of SEQ ID NO: 1 are indicated in boxes below. The secondary structures adjacent to the predicted loops are essentially similar to the known secondary structures for *Salmonella typhimurium* flagellin (FliC, Protein Data Bank ID (PDB): 1UCU) (Yonekura, K., et al., *Nature*, 424: 643-650 (2003)).

The predicted secondary structure of FliC (*S. typhimurium*, SEQ ID NO: 1) is substantially similar to the known high resolution atomic model determined by combination of X-ray crystallography and electron microscopy (1UCU, Yonekura, K., et al. *Nature*, 424: 643-650 (2003)). The substantial similarity between the predicted secondary structure and the known secondary structure of *S. typhimurium* FliC (SEQ ID NO: 1) indicates that secondary structures predicted employing CLUSTALW and PHD adjacent to loops of domain 3 of other flagellins, including *S. typhimurium* FljB (SEQ ID NO: 2), can be employed to select insertion sites that correspond to known loops in domain 3 in other flagellin, such as of *S. typhimurium* FliC.

Secondary structure prediction using PHD of Flagellin FliC (*Salmonella typhimurium*, Protein Data Bank ID: 1UCU, SEQ ID NO: 1) is depicted below. Predicted loops in domain 3 are indicated by boxed text.

```
            ....,....1....,....2....,....3....,....4....,....5....,....6
AA          AQVINTNSLSLLTQNNLNKSQSALGTAIERLSSGLRINSAKDDAAGQAIANRFTANIKGL
PROF_sec    EEE  HHHHHHHHHHHHHHHHHHHHHHHHH    EE     HHHHHHHHHHHHHHHHH ....,....7....,....8....,....9....,....10...,....11...,....12
AA          TQASRNANDGISIAQTTEGALNEINNNLQRVRELAVQSANSTNSQSDLDSIQAEITQRLN
PROF_sec    HHHHHHHH  HHHHHHHHHHHHHHHHHHHHHHHHHHHH      HHHHHHHHHHHHHHH ....,....13...,....14...,....15...,....16...,....17...,....18
AA          EIDRVSGQTQFNGVKVLAQDNTLTIQVGANDGETIDIDLKQINSQTLGLDTLNVQQKYKV
PROF_sec    HHHHHHH    EEEEE    EEEEEE      EEEEEEEEEE   EEEEEEEEEEE ....,....19...,....20...,....21...,....22...,....23...,....24
AA          SDTAATVTGYADTTIALDNSTFKASATGLQGTPQKIDGDLKHDDTTGKYYAKVTVIGGTG PROF_sec       EEEE     EEEEE EEE              EEE      EEEEEEEEEEE ....,....25...,....26...,....27...,....28...,....29...,....30
AA          KDGYYEVSVDKTNGEVTLAGGATSPLTGGLPATATEDVKNVQVANADLTEAKAALTAAGV PROF_sec    EEEEEEE    EEEEEEEE                        EEEE EEE ....,....31...,....32...,....33...,....34...,....35...,....36
AA          TGTASVVKMSYTDNNGKTIDGGLAVKVGDDYYSATQNKDGSISINTTKYTADDGTSKTAL
PROF_sec    EEEE          EEEE     EEE    EEEE    EE        EEE ....,....37...,....38...,....39...,....40...,....41...,....42
AA          NKLGGADGKTEVVSIGGKTYAASKAEGHNFKAQPDLAEAAATTTENPLQKIDAALAQVDT
PROF_sec    EE      EEEE   EEE                       HHHHHHHHHHHHHHHHHH ....,....43...,....44...,....45...,....46...,....47...,....48
AA          LRSDLGAVQNRFNSAITNLGNTVNNLTSVRSRIEDSDYATEVSNMSRAQILQQAGTSVLA
PROF_sec    HHHHHHHHHHHHHHHHHHHHHHHHHHHHH    HHHHHHHHHHHHHHHHHHHHHHHHH ....,....49...
AA          QANQVPQNVLSLLR   (SEQ ID NO: 1)
PROF_sec    HH   HHHHHHH    (predicted secondary structure)
```

Secondary structure prediction using PHD of Flagellin FljB (*S. typhimurium*, SEQ ID NO: 2). Predicted loops in domain 3 are indicated by boxed text.

```
             ....,....1....,....2....,....3....,....4....,....5....,....6
AA           MAQVINTNSLSLLTQNNLNKSQSALGTAIERLSSGLRINSAKDDAAGQAIANRFTANIKG
PROF_sec       EEEE  HHHHHHHHHHHHHHHHHHHHHH   EE     HHHHHHHHHHHHHHH ....,....7....,....8....,....9....,...10....,...11....,...12
AA           LTQASRNANDGISIAQTTEGALNEINNNLQRVRELAVQSANSTNSQSDLDSIQAEITQRL
PROF_sec     HHHHHHHHHHHHHHHHHHHHHHHHHHHHHHHHHHHHHHH    HHHHHHHHHHHHHH ....,...13....,...14....,...15....,...16....,...17....,...18
AA           NEIDRVSGQTQFNGVKVLAQDNTLTIQVGANDGETIDIDLKQINSQTLGLDSLNVQKAYD
PROF_sec     HHHHHHHH    EEEE     EEEEE     EEEEEEEE    EEEEEEEEEEEEE ....,...19....,...20....,...21....,...22....,...23....,...24
AA           VKDTAVTTKAYANNGTTLDVSGLDDAAIKAATGGTNGTASVIGGAVKFDADNNKYFVTIG PROF_sec        EEE      EEEEEEE EEEEE         EEE EEEEE   EEEEEEE ....,...25....,...26....,...27....,...28....,...29....,...30
AA           GFTGADAAKNGDYEVNVATDGTVTLAAGATKTTMPAGATTKTEVQELKDTPAVVSADAKN PROF_sec     E              EEEEE   EEEE                        EEE ....,...31....,...32....,...33....,...34....,...35....,...36
AA           ALIAGGVDATDANGAELVKMSYTDKNGKTIEGGYALKAGDKYYAADYDEATGAIKAKTTS
PROF_sec     EEEE        EEEEEE     EE    EEE    EEE ....,...37....,...38....,...39....,...40....,...41....,...42
AA           YTAADGTTKTAANQLGGVDGKTEVVTIDGKTYNASKAAGHDFKAQPELAEAAAKTTENPL
PROF_sec           EEEEEEEE    EEEE                          EE  HHHHHHHH ....,...43....,...44....,...45....,...46....,...47....,...48
AA           QKIDAALAQVDALRSDLGAVQNRFNSAITNLGNTVNNLSEARSRIEDSDYATEVSNMSRA
PROF_sec     HHHHHHHHHHHHHHHHHHHHHHHHHHHHHHHHH HHHHHHH   HHHHHHHHHHHH ....,...49....,...50....,.
AA           QILQQAGTSVLAQANQVPQNVLSLLR  (SEQ ID NO: 2)
PROF_sec     HHHHHHHHHHHHHH   HHHHHHH    (predicted secondary structure)
```

The predictions of loops in domain 3 employing PHD compared to known loops identified by X-ray crystallography show that the PHD computer program can be employed to predict amino acid sequences and loops for sites of insertion of antigens within domain 3 of a flagellin.

Sequence alignment between *S. typhimurium* FliC (SEQ ID NO: 1) and *S. typhimurium* FljB (SEQ ID NO: 2) was performed using the multiple sequence alignment tool CLUSTALW and secondary structure prediction by PHD with PROF_sec: structure prediction where "H" stands for alpha-helix and "E" stands for beta-strand (Thompson, J. D., et al., *Nucleic Acids Res.* 22: 4673-4680 (1994); Rost, B., et al., *Proteins* 19: 55-72 (1994)). The sequence alignment below showed about 74.75% identity of amino acid residues denoted with (*) and about 10.26% difference with about 7.30% strongly similar (:) and about 7.69% (.) weakly similar amino acid residues. Domain boundaries of D0, D1, D2 and D3 are underlined differently and three D3 insertion sites were marked.

The objective of this alignment was to predict loop regions in Domain 3 of *S. typhimurium* FljB (SEQ ID NO: 2) that correspond to known loop regions of Domain 3 of *S. typhimurium* FliC (SEQ ID NO: 1) for points of insertion of portions of HA that have an isoelectric point greater than about 7.0 to generate fusion proteins of the inventions.

Primary amino acid sequence alignment between FliC (PDB: 1UCU (Yonekura, K., et al., *Nature*, 424: 643-650 (2003)), SEQ ID NO: 1) and FljB (SEQ ID NO: 2) of *Salmonella typhimurium* indicated that the two flagellins shared highly conserved D0 (domain 0) and D1 (domain 1) domains, but varied in the D2 (domain 2) and D3 (domain 3) domains. However, secondary structure prediction, using PHD (Rost, B., et al., *Proteins* 19: 55-72 (1994)), showed that both D2 and D3 in the FliC flagellin FliC (SEQ ID NO: 1) and FljB flagellin (SEQ ID NO: 2) of *Salmonella typhimurium* share similar secondary structures, despite the differences in primary amino acid sequence.

Sequence alignment and secondary structure prediction using CLUSTALW and PHD of FliC (SEQ ID NO: 1) and FljB (SEQ ID NO: 2) of *S. typhimurium* is depicted below. Predicted loops in domain 3 are indicated by boxed text.

```
                          10         20         30         40         50         60
                          |          |          |          |          |          |
FliCxx0      MAQVINTNSLSLLTQNNLKSQSALGTAIERLSSGLRINSAKDDAAGQAIANRFTANIKG
1UCU             HHHHHHHHHHHHHHHHHHHHHHHHHHHHH            HHHHHHHHHHHHHHH
PROF_sec       EEE  HHHHHHHHHHHHHHHHHHHHHHH    EE       HHHHHHHHHHHHHHH
FlijBx1      MAQVINTNSLSLLTQNNLNKSQSALGTAIERLSSGLRINSAKDDAAGQAIANRFTANIKG
                                                         ~~~~~~~~~~~~~~~~~~
PROF_sec       EE  HHHHHHHHHHHHHHHHHHHHHHHHH   EE        HHHHHHHHHHHHHHH
             ************************************************************
```

```
                  70        80        90       100       110       120
                   |         |         |         |         |         |
FliCxx0     LTQASRNANDGISIAQTTEGALNEINNNLQRVRELAVQSANSTNSQSDLDSIQAEITQRL
1UCU        HHHHHHHHH   HHHHHHHHHHHHHHHHHHHHHHHHH    HHHHHHHHHHHHHHHH
PROF_sec     HHHHHHHH   HHHHHHHHHHHHHHHHHHHHHHHHH    HHHHHHHHHHHHHHHH
FlijBx1     LTQASRNANDGISIAQTTEGALNEINNNLQRVRELAVQSANSTNSQSDLDSIQAEITQRL
            ~~~~~~~~~~~~~~~~~~~~~~~~~~~~~~~~~~~~~~~~~~~~~~~~~~~~~~~~~~~
PROF_sec     HHHHHHHH   HHHHHHHHHHHHHHHHHHHHHHHHH    HHHHHHHHHHHHHHHH
            ************************************************************

130       140       150       160       170       180
                   |         |         |         |         |         |
FliCxx0     NEIDRVSGQTQFNGVKVLAQDNTLTIQVGANDGETIDIDLKQINSQTLGLDTLNVQQKYK
1UCU        HHHHHHHHHH      EEEEE      EEEEEE               EEEEE       E
PROF_sec    HHHHHHHH    EEEE    EEEEEE    EEEEEEEEEE   EEEEEEEEEEE
FlijBx1     NEIDRVSGQTQFNGVKVLAQDNTLTIQVGANDGETIDIDLKQINSQTLGLDSLNVQKAYD
            ~~~~~~~~~~~~~~~~~~~~~~~~~~~~~~~~~~~~~~~~~~~~~~~~~~~~~~-----
PROF_sec    HHHHHHHH    EEEE    EEEEE     EEEEEEEEEE   EEEEEEEEEEEE
            ************************************************:**: *.

190       200       210       220       230       240
                   |         |         |         |         |         |
FliCxx0     VSDTAATVTGYADT-----TIALDNSTFKASATGLGGT DQKIDGDLKFDDTTGKYYAKVT
1UCU        EEEE    EEEE      EEEE HHHH  HHHHH  EEEE     EEE         EEEEE
PROF_sec     EEEE             EEEEE EE         EEE   EEE  EEEEE
FlijBx1     VKDTAVTTKAYANNGTTLDVSGLDDAAIKAATGGTNGT ASVIGGAVKFDADNNKYFVTIG
            ------------
PROF_sec       EEE          EEEEEEE  EEEEE    EEE   EEE  EEEEE  EEEEEE
            *.***.*.....      .  .:::**:: * .**  . .* :* ..:..:

250       260       270       280       290       300
                   |         |         |         |         |         |
FliCxx0     -VTGG-TGKDGYYEVSVDKTNGEVTLAGGATSPLTGGLPATATEDKNVQVANADLTEAK
1UCU                EEEEEE     EEE                  EEE EEEEE  HHHHH
PROF_sec    EEEE E  EEEEEEE    EEEEEEEE                              EEEE
FlijBx1     GFTGADAAKNGDYEVNVA-TDGTVTLAAGATKTTMPAGATTKTEVQELKDTPAVVSADAK
                                                          -----------
PROF_sec    E      EEEEE      EEEE                                EEE
            .**. :.*:*.***.*  *:* **.*..     . ..:*   : :....  ::
D3I site            ↑             ↑         ↑

310       320       330       340       350       360
                   |         |         |         |         |         |
FliCxx0     AALTAAGVTGTAS----VVKMSYTDNNGKTIDGGLAVKVGDDYYSATQNKD-GSISINTT
1UCU        HHHHHH    EE    EEEEEEE    EEEEEEEEEE EEEE        EEE
PROF_sec    EEE        E    EEE        EEEE    EEE         EEEE
FlijBx1     NALIAGGVDATDANGAELVKMSYTDKNGKTIEGGYALKAGDKYYAADYDEATGAIKAKTT PROF_sec    EEEE          EEEEEE     EE   EEE    EEE
            ** *.**.*  :   :****:*: *:*..:*   ::  *:*. :**

370       380       390       400       410       420
                   |         |         |         |         |         |
FliCxx0     KYTADDGTSKTALNKLGGADGKTEVVSIGGKTYAASKAEGHNFKAQPDLAEAAATTTENP
1UCU              EEE    EEEEEE   EEEE HHHH                       HH
PROF_sec    EE    EEEEE   EEEE    EEE                              HHHHHHH
FlijBx1     SYTAADGTTKTAANQLGGVDGKTEVVTIDGKTYNASKAAGHDFKAQPELAEAAAKTTENP
                                                                    ~~~~~
PROF_sec          EEEEEEEE    EEEE                           EE   HHHHHHH
            .* *:*** *:*.*.**  .::* ***

430       440       450       460       470       480
                   |         |         |         |         |         |
FliCxx0     LQKIDAALAQVDTLRSDLGAVQNRFNSAITNLGNTVNNLTSVRSRIEDSDYATEVSNMSR
1UCU        HHHHHHHHHHHHHHHHHHHHHHHHHHHHHHHHHHHHHHH      HHHHHHHHH
PROF_sec    HHHHHHHHHHHHHHHHHHHHHHHHHHHHHHHHHHHHHHH      HHHHHHHHH
FlijBx1     LQKIDAALAQVDALRSDLGAVQNRFNSAITNLGNTVNNLSEARSRIEDSDYATEVSNMSR
            ~~~~~~~~~~~~~~~~~~~~~~~~~~~~~~~~~~~~~~~~~~~~~~~~~~~~~~~~~~~
PROF_sec    HHHHHHHHHHHHHHHHHHHHHHHHHHHHHHHH HHHHHH   HHHHHHHHHH
            ***********:******************:   .*  ********

490       500
                   |         |
FliCxx0     AQILQQAGTSVLAQANQVPQNVLSLLR        (SEQ ID NO: 1)
1UCU        HHHHHHHHHHHHHHHHHHHHHHHHHHH        (empirical structure)
PROF_sec    HHHHHHHHHHHHHH    HHHHHHH          (predicted secondary structure)
```

-continued

```
FlijBx1    AQILQQAGTSVLAQANQVPQNVLSLLR   (SEQ ID NO: 2)

PROF_sec   HHHHHHHHHHHHHHH    HHHHHHH   (predicted secondary structure)
           ***************************
```

An insertion site in a predicted loop in domain 3 of *S. typhimurium* FljB, referred to herein as "D3I-o1," for fusion of an antigen that has an isoelectric point greater than about 7.0, is between amino acid residues G277 and A278 of SEQ ID NO: 2. The insertion site D3I-o1 is between predicted β-strands VTLA (SEQ ID NO: 131), which is amino acid residues 263-266 of SEQ ID NO: 2, and VVS, which is amino acid residues 293-295 of SEQ ID NO: 2. Another insertion site in a second predicted loop in domain 3 of *S. typhimurium* FljB, referred to herein as "D3I-i1," is between residues T259 and D260 of SEQ ID NO: 2. The insertion site D3I-i1 is between β-strands EVNVA (SEQ ID NO: 132), which corresponds to amino acid residues 254-258 of SEQ ID NO: 2, and VTLA (SEQ ID NO: 131), which corresponds to amino acid residues 263-266 of SEQ ID NO: 2. An additional insertion site in a third predicted loop in domain 3 of *S. typhimurium* FljB, referred to herein as "D3I-s1," is between residue G244 and A245 of SEQ ID NO: 2. The insertion site of D3I-s1 is between β-strands KYFVTIGG (SEQ ID NO: 133), which corresponds to amino acid residues 234-241 of SEQ ID NO: 2, and EVNVA (SEQ ID NO: 132), which corresponds to amino acid residues 254-258 of SEQ ID NO: 2. The secondary structures adjacent to the predicted loops of *S. typhimurium* FliC are substantially similar to the predicted secondary structures adjacent to loops of domain 3 of *S. typhimurium* FljB and are depicted in FIG. 29.

In an embodiment, fusion of the antigen with an isoelectric point greater than about 7.0 can be about 2 to about 10 amino acids towards the carboxy- or amino-terminus of flagellin from the designated insertion site, based on the proximity of the adjacent secondary structural elements. For example, the D3I-o1 site can be from amino acid residues G268 through D289 of SEQ ID NO: 2, which does not invade adjacent β-strands, and are predicted at VTLA (SEQ ID NO: 131) at amino acid residues 263-266 of SEQ ID NO: 2 and VVS at amino acid residues 293-295 of SEQ ID NO: 2. In addition, for example, the D3I-i1 site can only accommodate a shift of 1 or 2 amino acids towards the carboxy-terminus of flagellin of SEQ ID NO: 2 at amino acid residues D260 or G261 of SEQ ID NO: 2 before disrupting the neighboring β-strands, which are predicted at EVNVA (SEQ ID NO:132) at amino acid residues 254-258 of SEQ ID NO: 2) and VTLA (SEQ ID NO: 131) at amino acid residues 263-266 of SEQ ID NO: 2.

Based on predicted secondary structure analysis, loops of domain 3 of *E. coli* FliC flagellin (SEQ ID NO: 3) and *Pseudomonas aeruginosa* PAO1 flagellin (SEQ ID NO: 4) can be predicted. Based on this analysis, *E. coli* FliC primary amino acid sequence (SEQ ID NO: 3) was aligned with the primary amino acid sequence of *Salmonella typhimurium* FliC (SEQ ID NO: 1). The secondary structures were assigned either directly from known structure of 1UCU for *Salmonella typhimurium* FliC. (SEQ ID NO: 1) or by prediction using PHD. The secondary structures of *E. coli* flagellin (SEQ ID NO: 3) or *Pseudomonas aeruginosa* PAO1 flagellin (SEQ ID NO: 4) were assigned using the PHD program. Designations depicted below are AA: Primary amino acid sequence; PROF_sec: Secondary structure prediction where "H" stands for α-Helix and "E" stands for beta-strand (Rost, B., et al., *Proteins* 19: 55-72 (1994)).

Secondary structure prediction using PHD of Flagellin FliC (*E. coli*, SEQ ID NO: 3) is depicted below. Predicted loops in domain 3 are in boxed text.

```
           ....,....1....,....2....,....3....,....4....,....5....,....6
AA         MAQVINTNSLSLLTQNNLNKSQSSLSSAIERLSSGLRINSAKDDAAGQAIANRFTANIKG
PROF_sec   EEEE  HHHHHHHHHHHHHHHHHHHHHHH     EE      HHHHHHHHHHHHHHHH ....,....7....,....8....,....9....,....10...,....11...,....12
AA         LTQASRNANDGISVAQTTEGALNEINNNLQRIRELSVQATNGTNSDSDLSSIQAEITQRL
PROF_sec   HHHHHHHHH  HHHHHHHHHHHHHHHHHHHHHHHHHHHH    HHHHHHHHHHHHHHH ....,....13...,....14...,....15...,....16...,....17...,....18
AA         EEIDRVSEQTQFNGVKVLAENNEMKIQVGANDGETITINLAKIDAKTLGLDGFNIDGAQK
PROF_sec   HHHHHHHH    EEEEE     EEEEE       EEEEEEEEE    EEEEEEEEEE ....,....19...,....20...,....21...,....22...,....23...,....24
AA         ATGSDLISKFKATGTDNYDVGGKTYTVNVESGAVKNDANKDVFVSAADGSLTTSSDTKVS PROF_sec        EEEEEE     EEEEE  EEEEEEE          EEEEEE EEEEEE   EE ....,....25...,....26...,....27...,....28...,....29...,....30
AA         GESIDATELAKLAIKLADKGSIEYKGITFTNNTGAELDANGKGVLTANIDGQDVQFTIDS PROF_sec   EEE  EEEEEEEEE    EEEE EEE             EEEEEE    EEEEEE ....,....31...,....32...,....33...,....34...,....35...,....36
AA         NAPTGAGATITTDTAVYKNSAGQFTTTKVENKAATLSDLDLNAAKKTGSTLVVNGATYNV
PROF_sec                  EEE     EEEEE    EEEEE   EEE     EEEEEEEEEEE ....,....37...,....38...,....39...,....40...,....41...,....42
AA         SADGKTVTDTTPGAPKVMYLSKSEGGSPILVNEDAAKSLQSTTNPLETIDKALAKVDNLR
PROF_sec   E   EEE     EEEEE       EEE        HHHHHHHHHHHHHHHHHHHH

....,....43...,....44...,....45...,....46...,....47...,....48
```

-continued

```
AA        SDLGAVQNRFDSAITNLGNTVNNLSSARSRIEDADYATEVSNMSRAQILQQAGTSVLAQA
PROF_sec  HHHHHHHHHHHHHHHHHHHHHH HHHHHHH   HHHHHHHHHHHHHHHHHHHHHHHHHHH ....,....49.
AA        NQTTQNVLSLLR (SEQ ID NO: 3)
PROF_sec      HHHHHHH  (predicted secondary structure)
```

Secondary structure prediction using PHD of flagellin (*P. aeruginosa* PAO1, SEQ ID NO: 4) is depicted below. Predicted loops in domain 3 are indicated by boxed text.

```
          ....,....1....,....2....,....3....,....4....,....5....,....6
AA        MALTVNTNIASLNTQRNLNASSNDLNTSLQRLTTGYRINSAKDDAGLQISNRLSNQISG
PROF_sec    EEEE  HHHHHHHHHHHHHHHHHHHHHHHH    EE      HHHHHHHHHHHHHHHH ....,....7....,....8....,....9....,....10..,....11..,....12
AA        LNVATRNANDGISLAQTAEGALQQSTNILQRIRDLALQSANGSNSDADRAALQKEVAAQQ
PROF_sec  HHHHHHHHHH HHHHHHHHHHHHHHHHHHHHHHHHHHHH      HHHHHHHHHHHHHHH ....,....13..,....14..,....15..,....16..,....17..,....18
AA        AELTRISDTTTFGGRKLLDGSFGTTSFQVGSNAYETIDISLQNASASAIGSYQVGSNGAG
PROF_sec  HHHHHHHH      EEEEE       EEEE     EEEEEEEEE   EEE EEEEE ....,....19..,....20..,....21..,....22..,....23..,....24
AA        TVASVAGTATASGIASGTVNLVGGGQVKNIAIAAGDSKAIAEKMDGAIPNLSARARTVF PROF_sec  EEEEE        EEEEEEEEEE   EEEEE        EEEEEE            EEE ....,....25..,....26..,....27..,....28..,....29..,....30
AA        TADVSGVTGGSLNFDVTVGSNTVSLAGVTSTQDLADQLNSNSSKLGITASINDKGVLTIT PROF_sec  E    EEE  EEEEEEEEE  EEEEE                  EEEEEEE    EEEEE ....,....31..,....32..,....33..,....34..,....35..,....36
AA        SATGENVKFGAQTGTATAGQVAVKVQGSDGKFEAAAKNVVAAGTAATTTIVTGYVQLNSP
PROF_sec  EE      EE         EEEEEEEE    EEEE  EEEE       EEEEEEEEEE ....,....37..,....38..,....39..,....40..,....41..,....42
AA        TAYSVSGTGTQASQVFGNASAAQKSSVASVDISTADGAQNAIAVVDBALAAIDAQRADLG
PROF_sec  EEEEE       EEEE          EE  EE  HHHHHHHHHHHHHHHHHHHHHHHHHH ....,....43..,....44..,....45..,....46..,....47..,....48
AA        AVQNRFKNTIDNLTNISENATNARSRIKDTDFAAETAALSKNQVLQQAGTAILAQANQLP
PROF_sec  HHHHHHHHHHHHHHHHHH HHHHHHH   HHHHHHHHHHHHHHHHHHHHHHHHHHH ....,....4
AA        QAVLSLLR   (SEQ ID NO: 4)
PROF_sec  HHHHHHH    (predicted secondary structure)
```

The *E. coli* FliC primary amino acid sequence (SEQ ID NO: 3) was initially aligned with the primary amino acid sequence of *Salmonella typhimurium* FliC (SEQ ID NO: 1). Sequence alignment was performed employing the multiple sequence alignment tool CLUSTALW and secondary structure prediction by PHD with PROF_sec: denoting secondary structure prediction where "H" stands for alpha-helix and "E" stands for β-strand (Thompson, J. D., et al., *Nucleic Acids Res.* 22: 4673-4680 (1994); Rost, B., et al., *Proteins* 19: 55-72 (1994)). The sequence alignment showed about 53.98% identity of amino acid residues denoted with (*) and about 21.91% difference with about 12.95% strongly similar (:) and about 11.16% (.) weakly similar amino acid residues. The predicted secondary structure of *E. coli* FliC (ECFlic, SEQ ID NO: 3) was substantially similar to that of *S. typhimurium* FliC(ST-FliC, Protein Data Bank ID: 1UCU (Yonekura, K., et al., *Nature* 424:643-650 (2003)), SEQ ID NO: 1) despite differences in primary amino acid sequences.

Sequence alignment and secondary structure prediction using CLUSTALW and PHD of *S. typhimurium* FliC (SEQ ID NO: 1) and *E. coli* FliC (SEQ ID NO: 3) to select loops in domain 3 for fusion for to antigens is depicted below. The predicted loops in domain 3 are indicated by boxed text.

```
                  10        20        30        40        50        60
                   |         |         |         |         |         |
STFlic    MAQVINTNSLSLLTQNNLNKSQSALGTAIERLSSGLRINSAKDDAAGQAIANRFTANIKG
1UCU        HHHHHHHHHHHHHHHHHHHHHHHHHHHHHH            HHHHHHHHHHHHHHHH
PROF_sec     EEE  HHHHHHHHHHHHHHHHHHHHHHHH    EE      HHHHHHHHHHHHHHHH
ECFlic    MAQVINTNSLSLLTQNNLNKSQSSLSSAIERLSSGLRINSAKDDAAGQAIANRFTANIKG
PROF_sec    EEEE  HHHHHHHHHHHHHHHHHHHHHHHH    EE      HHHHHHHHHHHHHHHH
          ***********************:*.:*********************************
```

```
                    70        80        90       100       110       120
                     |         |         |         |         |         |
STFlic      LTQASRNANDGISIAQTTEGALNEINNNLQRVRELAVQSANSTNSQSDLDSIQAEITQRL
1UCU        HHHHHHHHHHHHHHHHHHHHHHHHHHHHHHHHHH       HHHHHHHHHHHHHHHH
PROF_sec      HHHHHHHH   HHHHHHHHHHHHHHHHHHHHHHHH        HHHHHHHHHHHHHHHH
ECFlic      LTQASRNANDGISVAQTTEGALNEINNNLQRIRELSVQATNGTNSDSDLSSIQAEITQRL
PROF_sec      HHHHHHHH   HHHHHHHHHHHHHHHHHHHHHHHH        HHHHHHHHHHHHHHHH
            ************:******************:***:**:*:***.***.**********

130       140       150       160       170       180
                     |         |         |         |         |         |
STFlic      NEIDRVSGQTQFNGVKVLAQDNTLTIQVGANDGETIDIDLKQINSQTLGLDTLNVQ--QK
1UCU         HHHHHHHHHH    EEEEE    EEEEEE  EEEEEE     EEEEEEEEEE
PROF_sec     HHHHHHHH      EEEEE    EEEEEE  EEEEEEEEE  EEEEEEEEEE
ECFlic      EEIDRVSEQTQFNGVKVLAENNEMKIQVGANDGETITINLAKIDAKTLGLDGFNIDGAQK
AA          EEIDRVSEQTQFNGVKVLAENNEMKIQVGANDGETITINLAKIDAKTLGLDGFNIDGAQK
PROF_sec     HHHHHHHH      EEEEE    EEEEE   EEEEEEEEE  EEEEEEEEEE
            :****** **********::*  :.***********  *:*  *:::*****  *:::   **

190       200       210       220       230       240
                     |         |         |         |         |         |
STFlic      YKVSDTAATVTGYADTTIALDNSTFKASAT-GLG GT DQKI DGD LKF DDTTGKY YAKVTVT
1UCU          EEEEEE    EEEEEEEE  HHHH    HH HH      EEEE     EEE         EEEEEE
PROF_sec       EEEE      EEEEE  EEE                   EEE      EEEEEEEE
ECFlic      ATGSDLISKFKATGTDNYDVGGKTYTVNVESGAV KN DANK DV FVSA AD GSLTTSSDTKVS PROF_sec      EEEEEE     EEEEE  EEEEEEE              EEEEEE EEEEEE   EE
            . **  :.....   .  :...:*:.....   *   .*  :  *    :  :...*:

250       260       270       280       290       300
                     |         |         |         |         |         |
STFlic       G-GTGKD GYYEVSV DKTN-G EVTL AGGATSPLTGGLPATAT EDVKNVQVANADLTEAKAA
1UCU                EEEEEE     EEE           EEE EEEEE  HHHHHHHH
PROF_sec    EE E    EEEEEEEE    EEEEEEEE                     EEEEEE
ECFlic       GES IDATELAKLAIKL ADKGS IEYKGITF TNNTG---AELDANG KGVLTANIDGQDVQFT PROF_sec      EEE  EEEEEEEEE   EEEE EEE           EEEEEE    EEEEE
            *  . .    ::::.  ::  *.:   * : :   **   *    : *.*  .** *  :..:  :
D3I site    ↑               ↑              ↑

310       320       330       340       350       360
                     |         |         |         |         |         |
STFlic      LTAAGVTGTASVVKMSYTDNNGKTIDGGLAVKVGDDYYSATQNKDGSISINTTKYTADDG
1UCU         HHHH   EEEEEEEEEE   EEEEEEEEEE EEEE             EEE
PROF_sec    E         EEEE       EEEE    EEE      EEEE       EE
ECFlic      IDSNAPTGAGATIT---TDTAVYKNSAGQFTTTLVENKAATLS---DLDLNAAKKTGSTL
PROF_sec    E                EEE     EEEEE   EEEE      EEE       EEE
            : : .**:.:.:.   **.    .  .*   ...  :  :**  .   .:.:*:.:*  *..

370       380       390       400       410       420
                     |         |         |         |         |         |
STFlic      TSKTALNKLGGADGKTEVVSIGG--KTYAASKAEGHNFKAQPDLAEAAATTTENPLQKID
1UCU            EEE    EEEEEE  EEEE HHHH                    HH   HHH
PROF_sec       EEEEE   EEEE    EEE                   HHHHHHHH HHH
ECFlic      VVNGATYNVS-ADGKTVTDTTPGAPKVMYLSKSEGGSPILVNEDAAKSLQSTTNPLETID
            VVNGATYNVS  ADGKTVTDTTPGAPKVMYLSKSEGGSPILVNEDAAKSLQSTTNPLETID
PROF_sec    EEEEEEEEEE   EEE    EEEEE    EEE          HHHHHHHHHH
            . : *   ::.  *****  . :   *   *.  **:**  .       : *   :* ***:.**

430       440       450       460       470       480
                     |         |         |         |         |         |
STFlic      AALAQVDTLRSDLGAVQNRFNSAITNLGNTVNNLTSARSRIEDSDYATEVSNMSRAQILQ
1UCU        HHHHHHHHHHHHHHHHHHHHHHHHHHHHHHHHHHHHHH   HHHHHHHHHHHH
PROF_sec    HHHHHHHHHHHHHHHHHHHHHHHHHHHHHHHHHH     HHHHHHHHHHHHHH
ECFlic      KALAKVDNLRSDLGAVQNRFDSAITNLGNTVNNLSSARSRIEDADYATEVSNMSRAQILQ
PROF_sec    HHHHHHHHHHHHHHHHHHHHHHHHHHHHHHHHHH HHHHHH   HHHHHHHHHHHHHH
            ***:**.************:*************:********:*****************

490       500
                     |         |
STFlic      QAGTSVLAQANQVPQNVLSLLR    (SEQ ID NO: 1)
1UCU        HHHHHHHHHHHHHHHHHHH      (empirical structure)
PROF_sec    HHHHHHHHHH   HHHHHHH     (predicted secondary structure)
ECFlic      QAGTSVLAQANQTTQNVLSLLR    (SEQ ID NO: 3)
PROF_sec    HHHHHHHHHH   HHHHHH      (predicted secondary structure)
            ************..*******
```

Sequence alignment of *Salmonella typhimurium* FliC (STFlic, Protein Data Bank ID: 1UCU, SEQ ID NO: 1) and *Pseudomonas aeruginosa* PAO1 flagellin (SaFlix1, SEQ ID NO: 4) was performed by using the multiple sequence alignment tool CLUSTALW and secondary structure prediction by PHD with PROF_sec: denoting secondary structure prediction where "H" stands for alpha-helix and "E" stands for beta-strand (Thompson, J. D., et al., *Nucleic Acids Res.* 22: 4673-4680 (1994); Rost, B., et al., *Proteins* 19: 55-72 (1994)). The sequence alignment showed about 36.24% identity of amino acid residues denoted with (*) and about 30.10% difference with about 20.59% strongly similar (:) and about 13.07% (.) weakly similar amino acid residues.

Sequence alignment and secondary structure prediction using CLUSTALW and PHD of *S. typhimurium* FliC (SEQ ID NO: 1) and *P. aeruginosa* PAO1 flagellin (SEQ ID NO: 4) to select loops in domain 3 of the flagellin for fusion to antigens is depicted below. The predicted loops in domain 3 are indicated by boxed text.

```
                        10         20         30         40         50         60
                         |          |          |          |          |          |
          STFlic    MAQVINTNSLSLLTQNNLNKSQSALGTAIERLSSGLRINSAKDDAAGQAIANRFTANIKG
          1UCU          HHHHHHHHHHHHHHHHHHHHHHHHHHHH          HHHHHHHHHHHHHHH
          PROF_sec     EEE  HHHHHHHHHHHHHHHHHHHHHHHH     EE   HHHHHHHHHHHHHHHH
          SaFlix1   MALTVNTNIASLNTQRNLNASSNDLNTSLQRLTTGYRINSAKDDAAGLQISNRLSNQISG
          PROF_sec      EEEE HHHHHHHHHHHHHHHHHHHHHHHH    EE    HHHHHHHHHHHHHHHH
                    **  .:***  ** **.*** *.. *.*::**::* *********** *:**:: :*.*

70         80         90        100        110        120
                         |          |          |          |          |          |
          STFlic    LTQASRNANDGISIAQTTEGALNEINNNLQRVRELAVQSANSTNSQSDLDSIQAEITQRL
          1UCU      HHHHHHHHHHHHHHHHHHHHHHHHHHHHHHHHHHHHHHHHHHHH  HHHHHHHHHHHHHH
          PROF_sec   HHHHHHHH HHHHHHHHHHHHHHHHHHHHHHHHHHHHHHH    HHHHHHHHHHHHHHH
          SaFlix1   LNVATRNANDGISLAQTAEGALQQSTNILQRIRDLALQSANGSNSDADRAALQKEVAAQQ
          PROF_sec  HHHHHHHHH HHHHHHHHHHHHHHHHHHHHHHHHHHHHH      HHHHHHHHHHHHHH
                    *. *:********:***:****:: .* ***:*:**:****.:**::*   ::* *::  :

130        140        150        160        170        180
                         |          |          |          |          |          |
          STFlic    NEIDRVSGQTQFNGVKVLAQDN-TLTIQVGANDGETIDIDLKQINSQTLGLDTLNVQQKY
          1UCU      HHHHHHHHHH             E EEEEE      EEEEEE
          PROF_sec  HHHHHHHH     EEEEE     EEEEEE     EEEEEEEEE  EEEEEEEEEEE
          SaFlix1   AELTRISDTTTFGGRKLLDGSFGTTSFQVGSNAYETIDISLQNASASAIGSYQVGSNGAG
          PROF_sec  HHHHHHHH    EEEEE        EEEE    EEEEEEEE    EEE EEEEE
                    *: *:*. * *.* *:*   .   * :.***:*  ***** *::   ::.::* . :. :

190        200        210        220        230        240
                         |          |          |          |          |          |
          STFlic    KVSDTA--ATVTGYADTTIALDN-----STFKASATGLG[GT]DQKI[DGD]LKH[DDTTGKY]YA 1UCU      EEEEEE         EEEEEEEE H   HHH    HHHHH  EEEE    EEE    EEE
          PROF_sec          EEEE     EEEEE   EEE                EEE     EEE
          SaFlix1   TVASVAGTATASGIASGTVNLVGGGQVKNIAIAAGDSA[KA]IAEKM[DGA]IPNL[SARART]VF PROF_sec  EEEEE         EEEEEEEEEE    EEEEE       EEEEEE          EEE
                    .*:..*  **..:* *. *:: *.       *::.      :*:.**  :    .:  .::
          Prim.cons.2V222AGTAT22G2A22T22L22GGQVK2222A2222222222K2DG2222222222222

250        260        270        280        290        300
                         |          |          |          |          |          |
          STFlic    KVTVT[GGTGKL]GYYEVS[DKTNGE]VTL[AGGATSPLTGGLPATAT]EDVKNVQVANADLTEA 1UCU      EEE        EEEEEE     EEE                   EEE EEEEE    HHHH
          PROF_sec  EEEEEEEE    EEEEEEE    EEEEEEEE                              EEEE
          SaFlix1   TADVS[GVTGGS]LNFDVTV[GSN--T]VSL[AG------VTSTQDLADQ]LNSNSSKLGITASIND PROF_sec  E   EEE  EEEEEEEE       EEEEE                              EEEEEEE
                    .. *:* **  . ::*:*...   *:***         :*.   :    : :.  ::.  :
          D3I site       ↑              ↑       ↑

310        320        330        340        350        360
                         |          |          |          |          |          |
          STFlic    KAALTAAGVTGTASVVKMSYTDNNGKTIDGGLAVKVG--DDYYSATQNKDGSISINTTKY
          1UCU      HHHHHHH    EEEEEEEEE   EEEEEEEEEE    EEEE           EEE
          PROF_sec     EEE       EEEE       EEEE      EEEE              EEEE       E
          SaFlix1   KGVLTITSATGEN----VKFGAQTGTATAGQVAVKVQGSDGKFEAAAKNVVAAGTAATTT
          PROF_sec    EEEEEEE         EE       EEEEEEEE    EEEE  EEEE             E
                    *..** :..**      :.:  :.*.:   * :****  *. ..*: ::   : .  .:*.

370        380        390        400        410        420
                         |          |          |          |          |          |
          STFlic    TADDGTSKTALNKLGGADGKTEVVSIGGKTYAASKAEGHNFKAQPDLAEAAATTTENPLQ
          FliCxx0   TADDGTSKTALNKLGGADGKTEVVSIGGKTYAASKAEGHNFKAQPDLAEAAATTTENPLQ
          1UCU                  EEE        EEEEE   EEEE HHHH               HHHH
          PROF_sec  E    EEEEE      EEEE     EEE                       HHHHHHHHH
          SaFlix1   IVTGYVQLNSPTAYSVSGTGTQASQVFGNASAAQKSS------VASVDISTADGAQNAIA
          PROF_sec  EEEEEEEEE  EEEEE       EEEE               EE EE    HHHHHHHHH
                     . .. .: . :.     *:. .: *:: **.**.:.      ..:  ::* *.:
```

-continued

```
                    430        440        450        460        470        480
                     |          |          |          |          |          |
STFlic         KIDAALAQVDTLRSDLGAVQNRFNSAITNLGNTVNNLTSARSRIEDSDYATEVSNMSRAQ
1UCU           HHHHHHHHHHHHHHHHHHHHHHHHHHHHHHHHHHHHHHHHHH      HHHHHHHHHHH
PROF_sec       HHHHHHHHHHHHHHHHHHHHHHHHHHHHHHHHHHHHHHHHHH      HHHHHHHHHHHH
SaFlix1        VVDNALAAIDAQRADLGAVQNRFKNTIDNLTNISENATNARSRIKDTDFAAETAALSKNQ
PROF_sec       HHHHHHHHHHHHHHHHHHHHHHHHHHHHHHHHHHHHHH HHHHHHH  HHHHHHHHHHHH
               :* ***  :*: *:*********:..:.* ** *    :* *.*****:*:*:*:*.:  :*: *

490        500
                     |          |
STFlic         ILQQAGTSVLAQANQVPQNVLSLLR (SEQ ID NO: 1)
1UCU           HHHHHHHHHHHHHHHHHHHHHH    (empirical structure)
PROF_sec       HHHHHHHHHHHHH    HHHHHHH  (predicted secondary structure)
SaFlix1        VLQQAGTAILAQANQLPQAVLSLLR (SEQ ID NO: 4)
PROF_sec       HHHHHHHHHHHHH    HHHHHHH  (predicted secondary structure)
structure)     :******::******:** ******
```

The insertion site, referred to herein as "D3I-o1," in a loop of domain 3 of *S. typhimurium* FljB (SEQ ID NO: 2) for fusion to an antigen having an isoelectric point greater than about 7.5, is between predicted β-strands VTLA (SEQ ID NO: 131), which is amino acid residues 263-266 of SEQ ID NO: 2, and VVS, which is amino acid residues 293-295 of SEQ ID NO: 2. The insertion site, referred to herein as "D3I-i1," in a loop of domain 3 is between β-strands EVNVA (SEQ ID NO: 132), which corresponds to amino acid residues 254-258 of SEQ ID NO: 2, and VTLA (SEQ ID NO: 131), which corresponds to amino acid residues 263-266 of SEQ ID NO: 2). The insertion site, referred to herein as "D3I-s1," in a loop of domain 3, is between β-strands KYFVTIGG (SEQ ID NO: 133), which corresponds to amino acid residues 234-241 of SEQ ID NO: 2, and EVNVA (SEQ ID NO: 132), which corresponds to amino acid residues 254-258 of SEQ ID NO: 2 in FljB (*S. typhimurium*, SEQ ID NO: 2). The D3I-o1, D3I-i1 and D3I-s1 insertion sites predicted for *S. typhimurium* FljB (SEQ ID NO: 2) were loop conformations in the predicted secondary structures of *E. coli* (SEQ ID NO: 3) and *P. aeruginosa* (SEQ ID NO: 4) flagellin. Therefore, with reference to the loops in domain 3 of SEQ ID NO: 2, predicted loops in domain 3 and insertion sites, such as D3I-i1 and D3I-o1, can be selected for *E. coli* (SEQ ID NO: 3) and *P. aeruginosa* (SEQ ID NO: 4) flagellin.

Insertion sites in loops in domain 3 for fusion to antigens with an isoelectric point greater than about 7.0 in *E. coli* FliC flagellin (SEQ ID NO: 3), can include an D3I-o1 site between G274 and A275 of SEQ ID NO: 3 in the loop between β-strand ITF (amino acid residues 267-269 of SEQ ID NO: 3) and β-strand VLTANI (SEQ ID NO: 134, amino acid residues 284-289 of SEQ ID NO: 3). The D3I-i1 site is between A257 and D258 of SEQ ID NO: 3 in the loop between β-strand ELAKLAIKL (SEQ ID NO: 135, amino acid residues 248-256 of SEQ ID NO: 3) and IEYK (SEQ ID NO: 136, amino acid residues 262-265 of SEQ ID NO: 3). The D3I-s1 site was selected between S240 and G241 of SEQ ID NO: 3 in the loop between β-strand KV (residues 238-239 of SEQ ID NO: 3) and β-strand SID (residues 243-245 of SEQ ID NO: 3).

For *P. aeruginosa* flagellin (PAO1, SEQ ID NO: 4), the D3I-o1 site was selected between Q272 and D273 in the loop between β-strand TVSLA (SEQ ID NO: 137, amino acid residues 262-266 of SEQ ID NO: 4) and β-strand LGITASI (SEQ ID NO: 138, amino acid residues 285-291 of SEQ ID NO: 4). The D3I-i1 was between S260 and N261 of SEQ ID NO: 4 in the loop between β-strand SLNFDVTVG (SEQ ID NO: 139, amino acid residues 251-259 of SEQ ID NO: 4) and TVSLA (SEQ ID NO: 137, amino acid residues 262-266 of SEQ ID NO: 4). The D3I-s1 site was selected between S245 and G246 of SEQ ID NO: 4 in the loop between β-strand TVFT (SEQ ID NO: 140, residues 238-241 of SEQ ID NO: 4) and β-strand GVT (residues 246-248 of SEQ ID NO: 4).

Example 2

Fusion Proteins of an Influenza B HA Antigen that Replaces Domain 3 of Flagellin Compositions that include R3 constructs of flagellin fused to portions of HA have been described (U.S. patent application Ser. No. 12/905,584). Previously described R3 fusion proteins include Influenza A HA antigen from PR8 (H1, A/Puerto Rico/8/34, SEQ ID NO: 141), seasonal SI03 (H1, A/Solomon Island/3/2006, SEQ ID NO: 142), pandemic CA07 (H1, A/California/07/2009, SEQ ID NO: 143), and IN05 (H5, A/Indonesia/5/2005, SEQ ID NO: 144), which are immunologically potent with minimal side-effects (U.S. patent application Ser. No. 12/905,584).

Figure 2A:
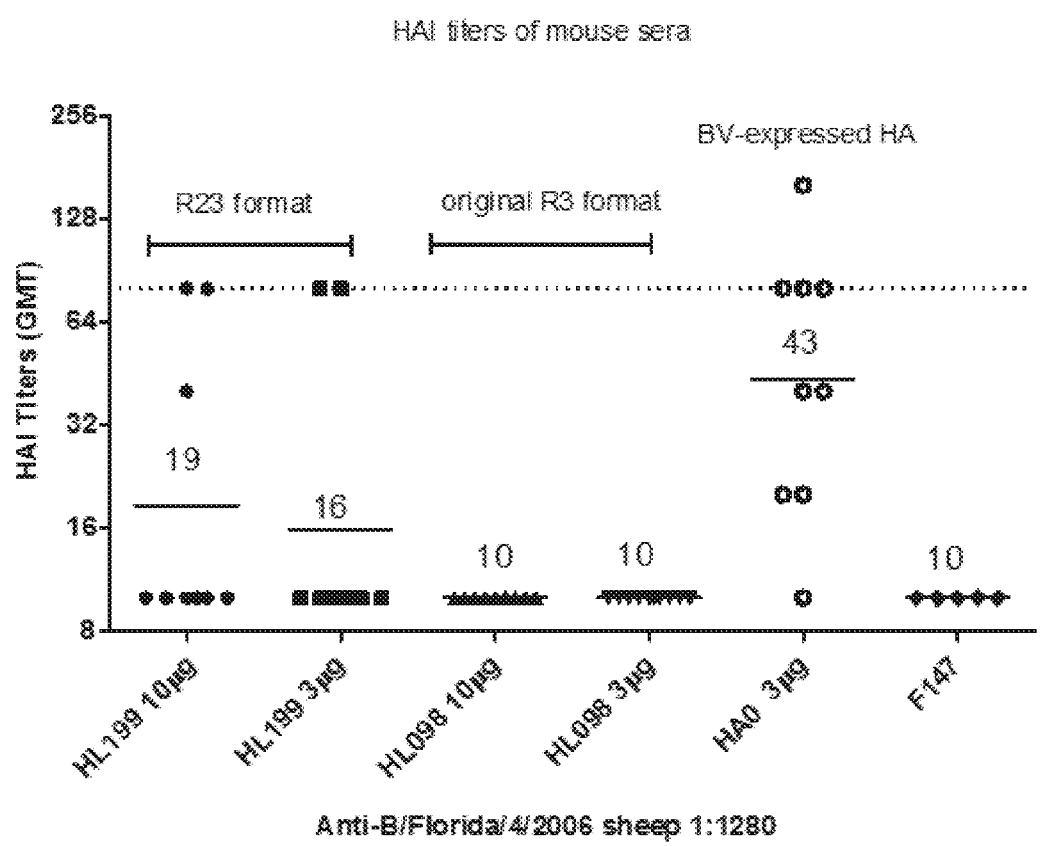
FIG. 2A shows that a fusion protein (SEQ ID NO: 122) that includes an R3 format of flagellin and a portion of HA (SEQ ID NO: 45), without a negatively charged linker (SEQ ID NO: 123) between the HA antigen and flagellin, did not induce an immunogenic response to the HA component of the fusion protein. Serum HAI antibody titers were measured by HAI test against B/Florida/4/06, and plotted as individual values with geometric mean titers (GMTs, horizontal lines) with 10 μg (●) or 3 μg (■) of HL199 (SEQ ID NO: 45) or with 10 μg (▲) or 3 μg (▼) of HL098 (SEQ ID NO: 122). F147 formulation buffer was used a negative control (◆). BV (baculovirus) expressed HA0 (○, full-length HA) was used as a positive control.

However, R3 constructs fused to Flu B HA1-2 portions having a fl-sheet at the bottom of the globular head, such as B/Florida/4/2006 (B/FL) of Yamagata lineage (HL098, SEQ ID NO: 122), were poorly immunogenic in a mouse model (FIG. 2A). In this study, groups of 5-10 BALB/c mice (female, 6-8 weeks old) were immunized twice (day 0 and day 21) subcutaneously (s.c.) or intramuscularly (i.m.) with 10 μg (●) or 3 μg (■) of HL098 (SEQ ID NO: 122) or with 10 μg (▲) or 3 μg (▼) of HL199 (SEQ ID NO: 145). The HL098 fusion protein includes a flagellin that lacks domain 3 and replaces it with an HA1-2 (SEQ ID NO: 45), which is referred to herein as an "R3 construct." The HL199 fusion protein includes a flagellin that lacks domains 2 and 3 and replaces domains 2 and 3 with an HA1-2 (SEQ ID NO: 45), which are referred to herein as "R23 constructs." Mice were bled on day 35 after the booster immunization. Serum samples were prepared and stored at −20° C. until use. Serum antibody titers were measured by hemaglutination inhibition (HAI) assay or microneutralization (MN) assay.

The HAI test was used to measure the influenza HA specific antibodies in serum samples (Liu, G., et al., *PLoS ONE* 6(6):e20928 (2011); Kendal, A. P., et al., *J. Clin. Microbiol.* 18(4):930-934 (1983)). In this assay, immune serum samples, collected at various times after immunization, were treated with receptor destroying enzyme (RDE) II overnight to eliminate non-specific hemagglutination inhibitors. The samples were then heat inactivated (56° C., about 30-45 min), serially diluted starting at about a 1:5 ratio, and incubated with about 4 HA units (HAU) of influenza B virus for about 30 minutes at room temperature. Turkey red blood cells (0.5%) were incubated with the samples for about 30 to about 60 min at room temperature. HAI titers were measured and reported as the reciprocal of the highest dilution at which hemagglutination is completely inhibited. Ferret post infection anti-influenza B virus (from the Center for Disease Control) is used as reference serum. Serum HAI antibody titers were measured by HAI test against B/Florida/4/06, and plotted as individual values with geometric mean titers (GMTs). HL098 (SEQ ID NO: 122) elicits no HAI titers.

F147 buffer, the negative control, contains 10 mM L-histidine, 150 mM NaCl, 5% trehalose, 0.02% polysorbate 80, 0.1 mM EDTA, 0.5% ethanol, and 10 mM Tris at pH 7.2. F147 is a buffer control (♦) and BV (baculovirus) expressed HA0 (○, full-length HA) is used as a positive control. As shown in FIG. 2A, none of the mice generated neutralizing antibodies to the original R3 format composition. A modest improvement in immunogenicity was observed with the alternative fusion protein format in which the HA1-2 portion (SEQ ID NO: 45) replaced both D2 and D3 domain, termed R23 (HL199, SEQ ID NO: 145). However, the activity was not sufficient (too low) to advance the composition for use in methods for clinical development. In subsequent testing, R23 (HL199; SEQ ID NO: 145) was used as a base line for comparison to generate new, improved fusion proteins.

Figure 2B:
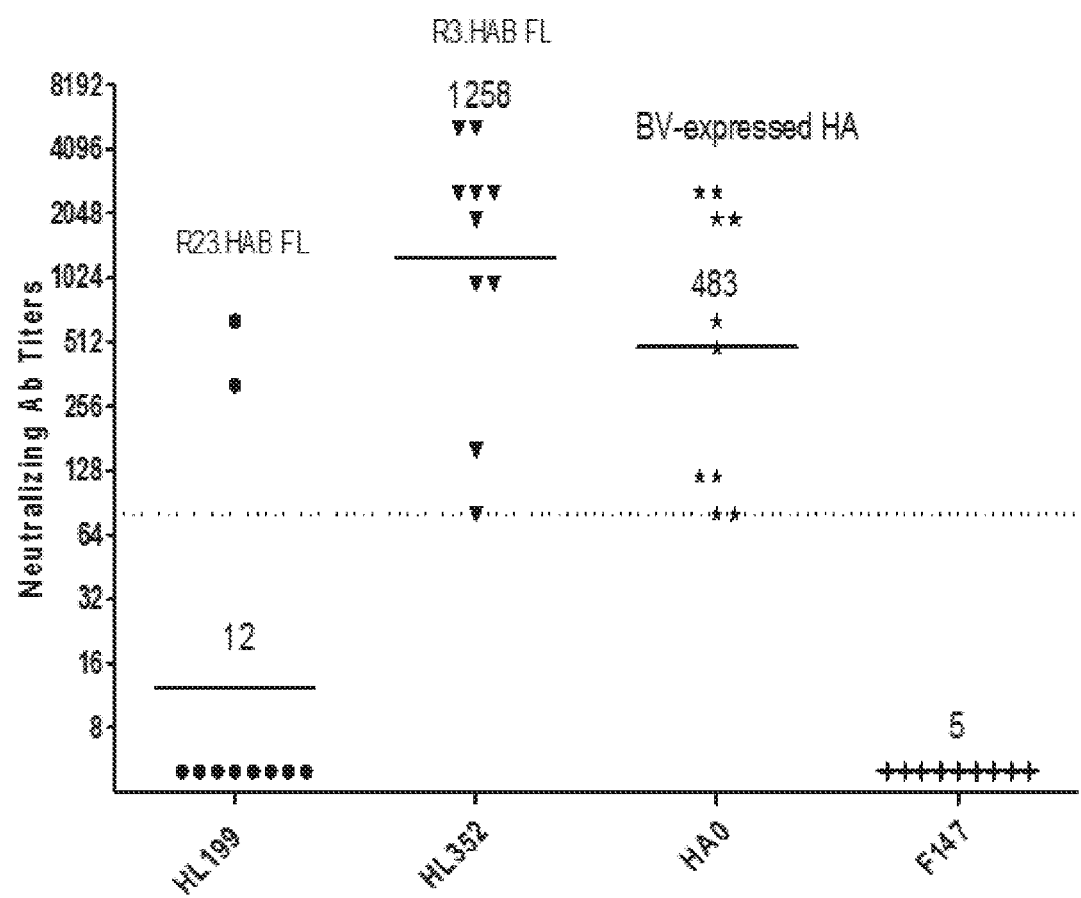
FIG. 2B shows that the inclusion of an amino acid linker with a net negative charge (SEQ ID NO: 123) in the fusion protein depicted in FIG. 2A (SEQ ID NO: 122) improved immunogenicity to the HA component of the fusion protein. Serum antibody titers were measured by MN test against B/Florida/4/06 virus, and plotted individually with GMTs (horizontal lines) with HL199 (●, SEQ ID NO: 145) or HL352 (▼, SEQ ID NO: 125). Control groups included the formulation buffer (+, F147, negative) and BV (baculovirus) expressed HA0 (*, full-length HA, positive).

The predicted isoelectric point (pI) of the portion of HA of influenza B (Flu B), for example, the HA1-2 portion of the globular head of Flu B (SEQ ID NO: 45), is between about 8.5 to about 9.5, which is relatively high compared that of H1 Influenza A that has a pI of about 7.0, or those of H5 Influenza A that has a pI of about 8.0. The positively charged amino acids in a portion of a globular head of Influenza B HA (e.g., SEQ ID NOs: 8, 9, 45, and 61) may interact with the negatively charged flagellin at neutral pH. As a result, an undesirable charge-charge interaction may distort the fusion protein conformation, which could interfere with TLR5 signaling by the flagellin component of the fusion protein and presentation of the antigen component of the fusion protein. Various efforts to lower the pI of the Flu B globular head, such as introducing negative amino acid residues in non-antigenic regions were unsuccessful. The addition of negatively charged residues in the linking region between HA head and flagellin improved TLR5 signaling and the fusion protein immunogenicity. For example, if 9 amino acid residues (SEQ ID NO: 123) having a negative charge were fused to the C-terminus of the of an HA1-2 portion of influenza B (HL352, SEQ ID NO: 125), which naturally contains two negatively charged residues (E306 and D308), immunogenicity of the Flu B fusion protein was moderately improved (FIG. 2B). This 9 amino acid residue of SEQ ID NO: 123 is native to the naturally occurring HA. In another embodiment, additional negatively charged amino acid residues can be added to the portion of HA or negatively charged amino acid residues can replace naturally occurring amino acid residues at the carboxy-terminus of the HA.

In this study, serum was evaluated in the microneutralization (MN) test (Rowe, T., et al., *J. Clin. Microbiol.* 37:937-943 (1999); Song, L., et al. *PLoS ONE* 3:e2257 (2008)). Briefly, groups of 10 BALB/c mice were treated s.c. with fusion protein compositions containing HL199 (●, SEQ ID NO: 145) or HL352 (▼, SEQ ID NO: 126) on days 0 and 21, and bled on day 35. Serum samples were treated with receptor destroying enzyme II, serially diluted in duplicate, starting at a ratio of about 1:10 and co-cultivated with 100 $TC_{ID50}$ (tissue culture infective dose, TCID) of influenza B virus for about 1.5 hr. Madin-Darby Canine Kidney (MDCK) cells (about $4 \times 10^4$/well) were then added and incubated for about 20 hours at about 37° C. Cells were washed, fixed, air-dried and incubated with a monoclonal anti-influenza B nucleoprotein antibody (primary) and goat anti-mouse Fcγ specific IgG:HRP (secondary). Serum antibody titers were measured by MN test against B/Florida/4/06 virus, and plotted individually with GMTs (horizontal lines, FIG. 2B). Control groups include the formulation buffer (+, F147, negative) and BV (baculovirus) expressed HA0 (*, full-length HA, positive). The negative charges in the linker fusing the HA portion to flagellin may alleviate the charge-charge interactions and allow flagellin to bind to TLR5 more efficiently, which results in adaptive immune responses.

The ability of fusion proteins described herein to stimulate the innate arm of the immune system, i.e., the TLR5 bioactivity, was assessed by an in vivo TLR5 assay The assay consists of an in-life phase and an in vitro serum cytokine rise readout. In general, groups of BALB/c mice (5 per group) were injected with vehicle control (naïve) or test fusion protein compositions at about 1 µg each. Three hours later, mice were bled and the serum was prepared and analyzed for inflammatory cytokines using a mouse cytometric bead array (CBA) from BD (BD Biosciences, San Jose, Calif.), and run on a flow cytometer.

Figure 3A:
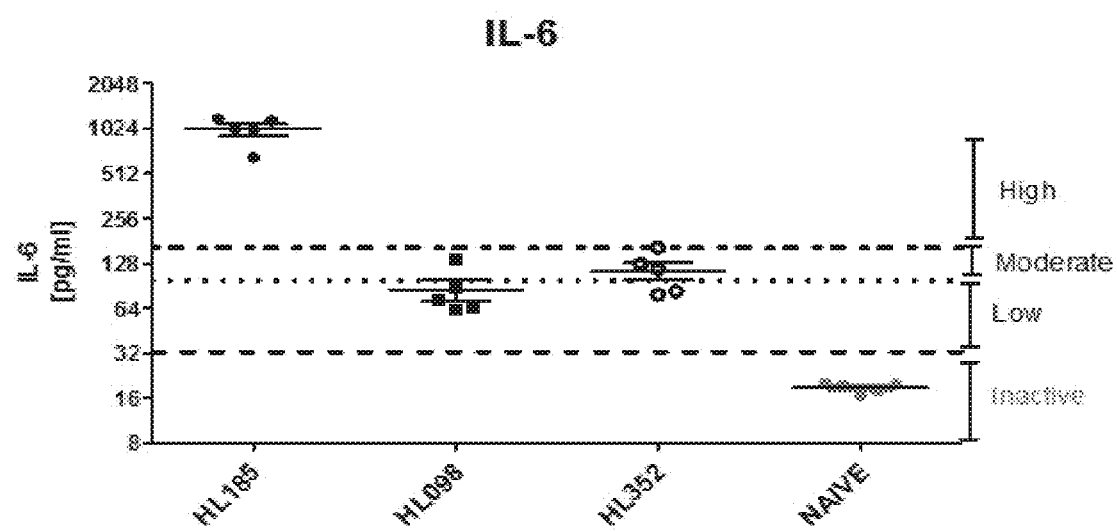
FIGS. 3A and 3B show in vivo TLR5 stimulated cytokine production: Comparison of fusion proteins for B/FL (Yamagata lineage) compositions: R3.HA1-2 B (■, HL098, SEQ ID NO: 122) and R3.HA1-2 B with a 9 amino acid linker B (○, HL352, SEQ ID NO: 125). R3.HA1 (●, HL185, SEQ ID NO: 143) was included as a positive control. Dotted lines indicate (1) mean+3 standard deviations (SD) of naive mice (____); (2) mean+1 SD of HL077 ( . . . , SEQ ID NO: 146); or (3) mean+3 SD of HL185 (_._, ●, SEQ ID NO: 143). IL-6 (FIG. 3A) and TNF (FIG. 3B) levels of individual mice are shown, along with bars representing the mean and standard error.
Figure 3B:
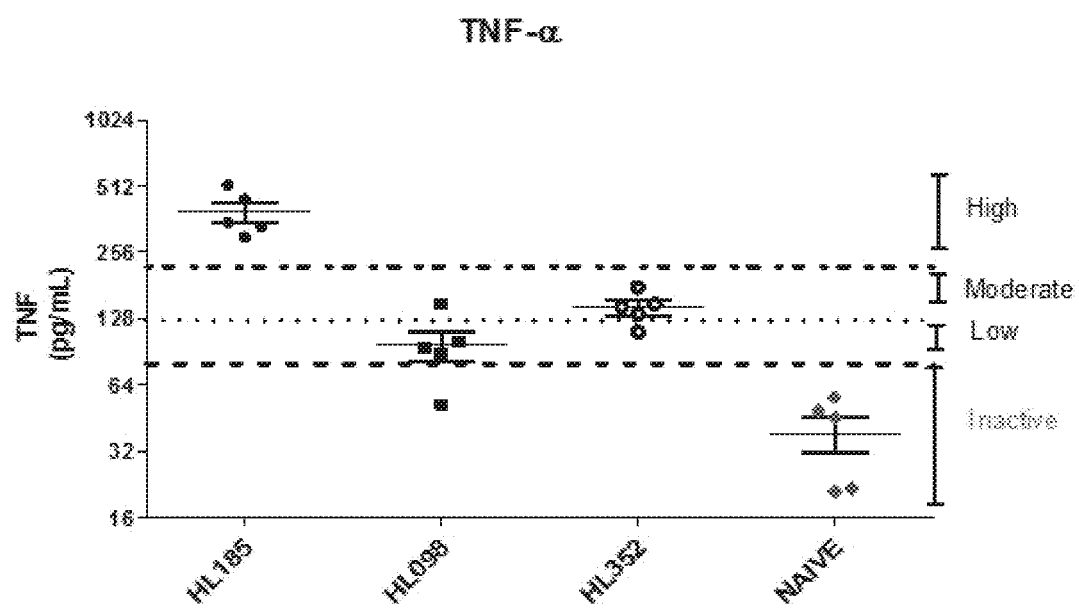

For the cytokine assessment, only IL-6 and TNF-α displayed a range of responses that are useful for characterizing fusion protein composition candidates while others either produced only baseline levels at the dose and time point chosen, or produced plateau levels which are not useful for differentiation of composition potency to stimulate TLR5 activation (data not shown). Using naïve serum levels, as well as those from low potency fusion protein (STF2.HA1-2, B/Florida/4/2006, SEQ ID NO: 146) that generated low micro-neutralization (MN) titers, thus the minimum innate immune stimulation required for an immune response, 4 zones of activity were established. These 4 zones of activity levels are depicted in FIGS. 3A and 3B. The lowest level of cytokine activity, which is designated as inactive, consists of levels less than about or equal to the mean plus 3 standard deviations (SD) of that detected in naïve mice. The next level, which is designated as low, consists of levels from greater than about the mean plus 3 SD of the naïve and less than about or equal to the mean plus 1 SD of low potency fusion protein (SEQ ID NO: 146). The next zone, which is designated as moderate, consists of values greater than about the mean plus 1 SD of low potency fusion protein composition but less than about or equal to the mean plus 3 SD of high potency fusion protein composition (HL185, STF2R3.HA1-2, an R3 construct) (A/California/07/2009, CA07), SEQ ID NO: 143). Finally, the fourth zone, designated as high, is for values greater than about the mean plus 3 Standard deviations (SD) of high potency composition.

In vivo TLR5 bioassays were employed to evaluate charge-charge interactions that may influence TLR5 binding activity. The addition of a 9 amino acid negatively charged linker (SEQ ID NO: 123) to a fusion protein that includes an HA1-2 portion of Influenza B/Florida/4/2006 to generate the fusion protein referred to as HL352 (SEQ ID NO: 125) improved cytokine responses, as shown by elevated IL6 and TNF-α responses (FIGS. 3A and 3B).

Figure 4A:
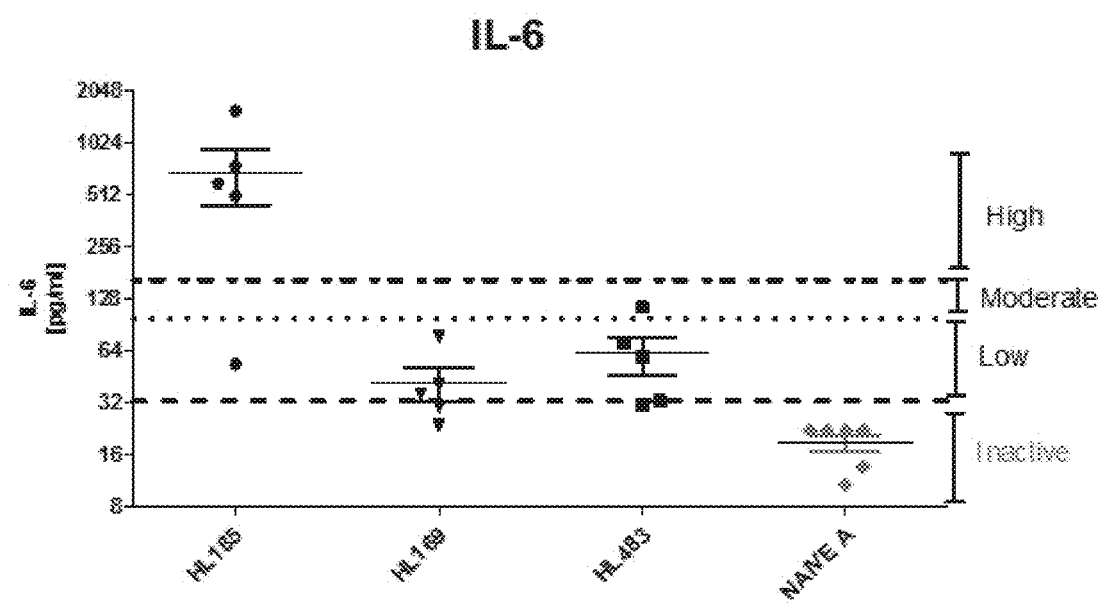
FIGS. 4A and 4B show in vivo TLR5 stimulated cytokine production: Comparison of fusion proteins for B/BR (Victoria lineage) compositions: R3.HA1-2 B (▼, HL169, SEQ ID NO: 147) and R3.HA1-2 B with a 9 amino acid linker B (■, HL483, SEQ ID NO: 148). R3.HA1 (●, HL185, SEQ ID NO: 143) was included as a positive control. Dotted lines indicate (1) mean+3 standard deviations (SD) of naive mice (____); (2) mean+1 SD of HL077 ( . . . , SEQ ID NO: 146); and (3) mean+3 SD of HL185 (_._, ●, SEQ ID NO: 143). IL-6 (FIG. 4A) and TNF (FIG. 4B) levels of individual mice are shown, along with bars representing the mean and standard error.
Figure 4B:
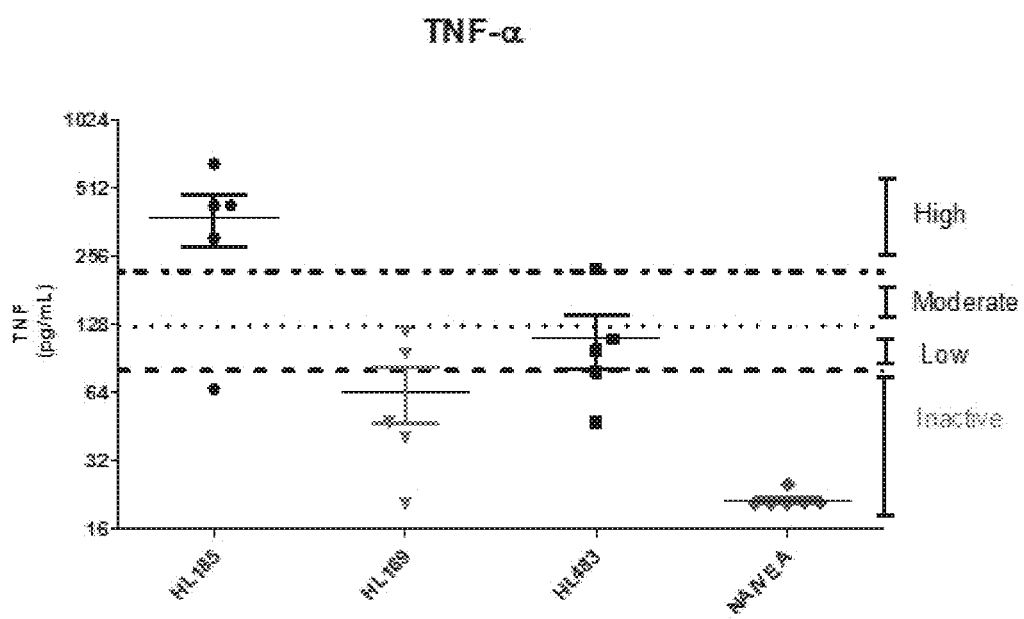

Similar results were obtained for a fusion protein employing sequences from B/Brisbane/60/2008 (B/BR) as a protoypical composition for the Victoria lineage (FIGS. 4A and 4B). FIGS. 4A and 4B show the Balb/c mice were left naïve (♦) or injected with the indicated fusion protein composition for the B/BR (Victoria lineage), at a 1 µg dose: R3.HA1-2 B (▼, HL169, SEQ ID NO: 147) and R3.HA1-2 B with a 9 amino acid linker B (■, HL483, SEQ ID NO: 148). The R3.HA1 (●, HL185, SEQ ID NO: 143) fusion protein was included as a positive control. At 3 hours, mice were bled to generate serum. Cytokine levels were quantified using a mouse inflammation cytometric bead array (BD Biosciences, San Jose, Calif.). Dotted lines in FIGS. 4A and 4B indicate the activity levels discussed above.

An additional three negatively charged amino acid residues were added to the carboxy-terminus of the portion of HA in the fusion proteins HL610 (SEQ ID NO: 149) for B/FL and HL611 for B/BR (SEQ ID NO: 150) for a total of 5 negatively charged amino acid residue extension. The three negatively charged residues are native to the naturally occurring HA sequence. For example, the three negatively charged amino acid residues substitutions can be K298E, S300D and 1304D in HA B/FL of SEQ ID NO: 124 or K299E, S301D and 1305D in HA B/BR60 of SEQ ID NO: 264. The three negatively charged amino acid residues are not necessary a continuous stretch of amino acid residues in the naturally occurring HA protein. The negatively charged amino acid residues may reduce charge-charge interaction between the positively charged portion of the HA globular head and the negatively charged flagellin, to thereby minimize charge-charge intramolecular interactions between the antigen and flagellin component of the fusion proteins.

Figure 5A:
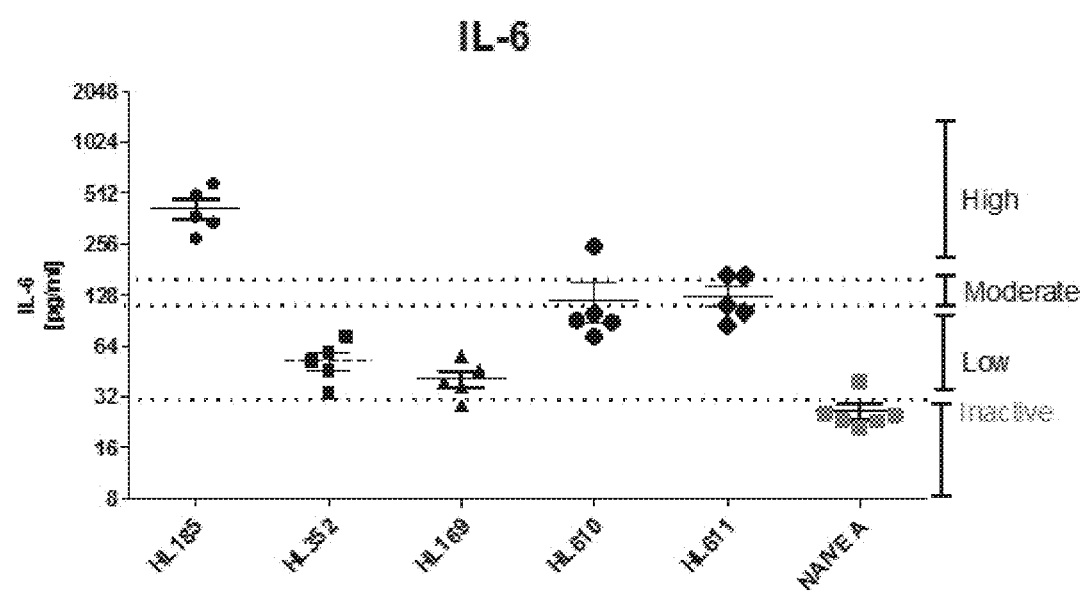
FIGS. 5A and 5B show in vivo TLR5 stimulated cytokine production: Comparison of fusion protein compositions with additional negative charges. Dotted lines indicate thresholds of cytokines levels correlated with immunogenicity. IL-6 (FIG. 5A) and TNF (FIG. 5B) levels of individual mice are shown, along with bars representing the mean and standard error. Formats for B/FL (Yamagata lineage) were compared: R3.HA1-2 B with a 9aa (amino acid) linker (SEQ ID NO: 123) B (■, HL352, SEQ ID NO: 125) and the same format with additional negative charges introduced in the linker (●, HL610, SEQ ID NO: 149). Formats for B/BR (Yamagata lineage) were compared: R3.HA1-2 B with a 9aa linker (SEQ ID NO: 123) B (▲, HL169, SEQ ID NO: 147) and the same format with additional negative charges introduced in the linker (◆, HL611, SEQ ID NO: 150). R3.HA1 (●, HL185, SEQ ID NO: 143) was included as a positive control and naïve (■) as a negative control.
Figure 5B:
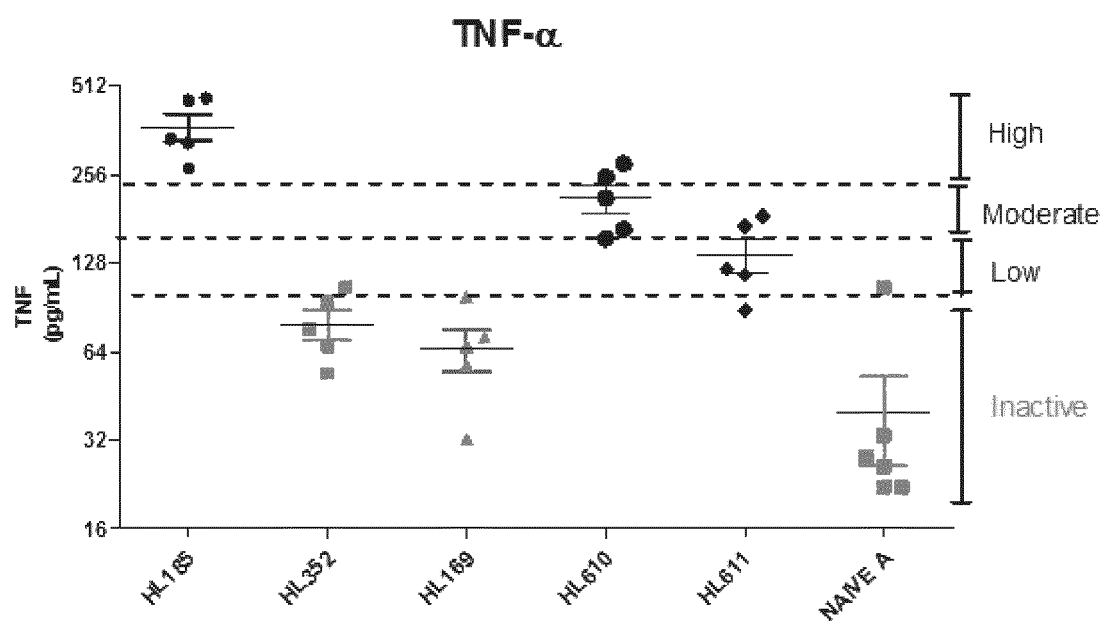

The in vivo TLR5 bioassay was performed as above with Balb/c mice were left naïve (■) or injected with the indicated fusion protein composition at a 1 μg dose: B/FL (Yamagata lineage) R3.HA1-2 B with a 9 amino acid linker of SEQ ID NO: 123 (■, HL352, SEQ ID NO: 125) and the same format with additional negative charges (described supra, K298E, S300D and 1304D in HA B/FL in SEQ ID NO: 125 and K299E, S301D and 1305 in HA B/BR60 in SEQ ID NO: 264 introduced in the linker (●, HL610, SEQ ID NO: 149) and B/BR (Yamagata lineage) R3.HA1-2 B with a 9 amino acid linker (SEQ ID NO: 123) (▲, HL169, SEQ ID NO: 147) and the same format with additional negatively charged amino acids introduced in the linker (♦, HL611, SEQ ID NO: 150). R3.HA1 (●, HL185, SEQ ID NO: 143) was included as a positive control. Dotted lines in FIGS. 5A and 5B indicate thresholds of cytokines levels correlated with immunogenicity as, described above. Constructs HL610 (SEQ ID NO: 149) and HL611 (SEQ ID NO: 150) improved the cytokine profiles compared to constructs HL352 (SEQ ID NO: 125) and HL169 (SEQ ID NO: 147) (FIGS. 5A and 5B).

In addition to the in vivo TLR5 cytokine assay that was used to assess the functionality of flagellin moiety, a neutralization inhibition assay (NIA) was employed to evaluate the potency of the HA moiety. NIA was used to measure the ability of a fusion protein composition to compete with virus for binding to neutralizing antibodies present in sheep hyper-immune serum (available from CBER, Center for Biologics Evaluation and Research in FDA), similar to that used for the potency release assay (SRID, Single Radial Immunodiffusion) of a commercial influenza composition (TIV, Trivalent Influenza Vaccine (TIV) containing two different inactivated influenza type A strains and one inactive influenza type B strain, e.g. FLUVORIN®), thereby assessing the integrity of neutralizing epitopes on the fusion proteins described herein.

In the NIA assay, higher potency of the fusion proteins was demonstrated by increased depletion of the neutralizing antibodies in the sheep hyper-immune serum, which allows the test virus to infect MDCK cells. The sheep hyper-immune serum raised against the test Flu B influenza virus (sheep anti-HA of B/Florida/4/06 serum (FDA) or sheep anti-HA of B/Brisbane/60/08 serum (FDA)) was pre-incubated with serially diluted test articles at about a 1:1 ratio for about 90 minutes. 50 $TCID_{50}$ B/Florida/4/06 virus or 50 $TCID_{50}$ B/Brisbane/60/08 virus was then added and allowed to incubate for about 1 hour at 37° C. prior to addition of MDCK cells. Following an incubation of about 18 hours to about 20 hours of the mixture with MDCK cells at about 37° C., the cells were fixed with a cold solution of 80% acetone in DPBS (1.47 mM KH2PO4, 2.67 mM KCl, 138 mM NaCl, 8.06 mM Na2HPD4.7H$_2$O, Invitrogen Cat. No. 14190-250).

Intracellular influenza virus was quantified in an ELISA (enzyme-linked immunosorbent assay) format using influenza B NP-specific (nuclear protein-specific) mAbs (monoclonal antibodies) as primary antibodies and horseradish peroxidase (HRP) conjugated goat anti-mouse IgG (Jackson ImmunoResearch, Cat. no. 115-035-008). After color development with TMB (3,3'-5,5'-tetramethylbenzidine) substrate (ThermoScientific, Cat. no. 34028), the virus was quantified by measuring $OD_{450}$. NIA curves were generated by Log-Logit fit model using Softmax software 5.2. The greater the integrity of the neutralizing epitopes in the composition the higher infectivity of the virus and the higher the signal in the NIA assay.

Figure 6:
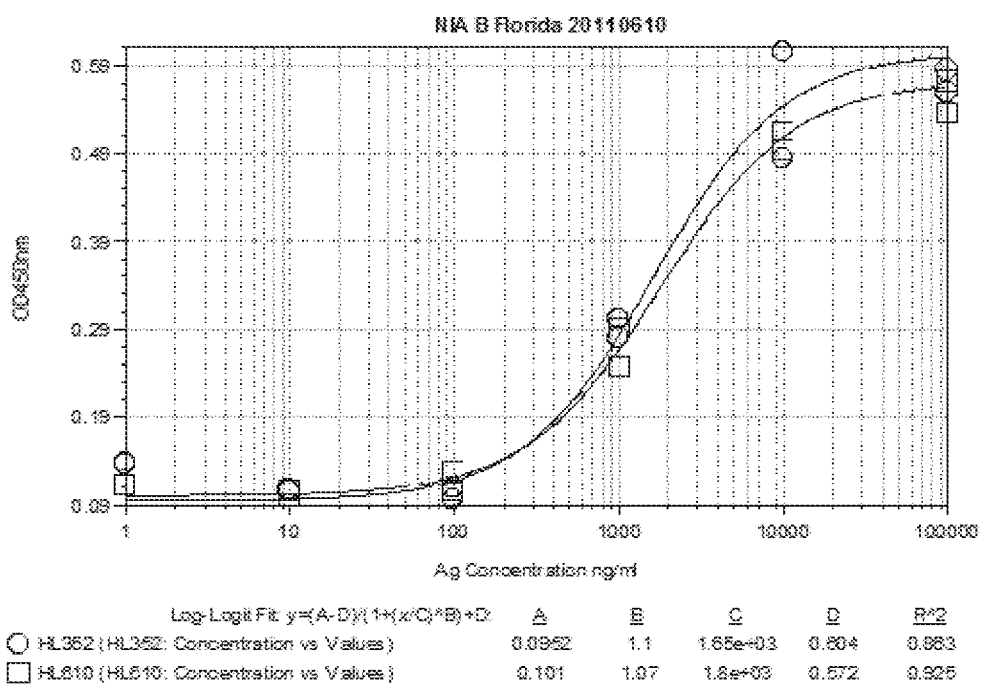
FIG. 6 shows similar NIA activities of the two B/FL compositions that contain negatively charged amino acids in the linkers: B/Florida/4/06 R3 fusion protein compositions HL352 (○, SEQ ID NO: 125) and HL610 (□, SEQ ID NO: 149).
Figure 7:
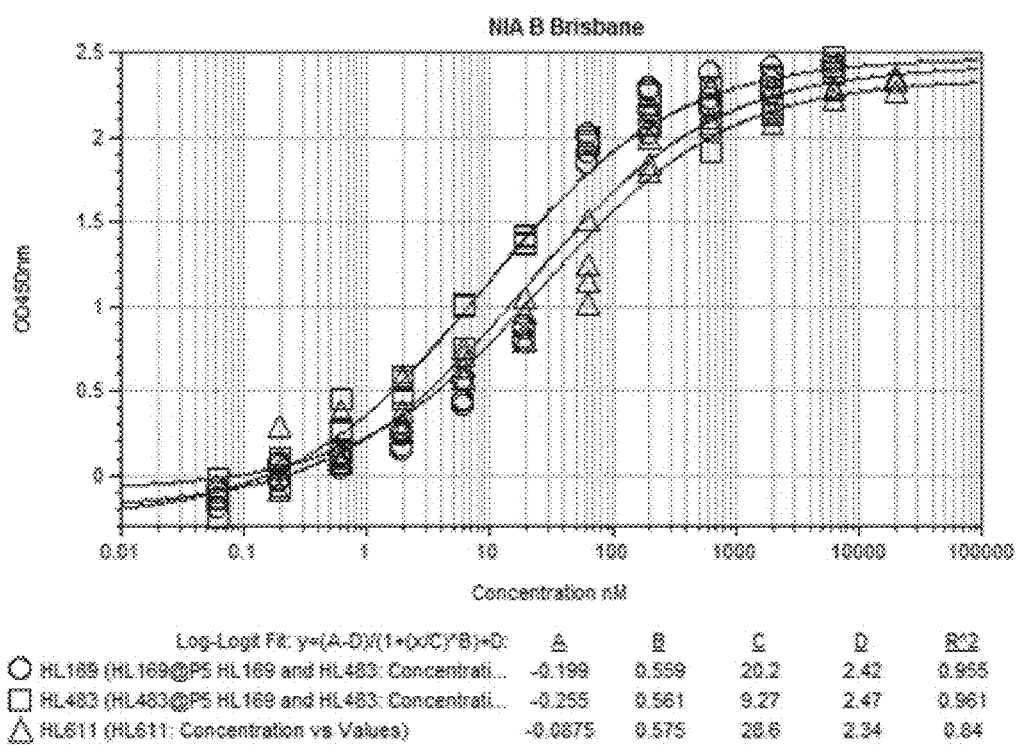
FIG. 7 shows a comparison of NIA activities of B/BR compositions with or without the use of additional negative charged amino acid residues (SEQ ID NO: 153) in the portion of HA that includes a portion of the globular head of HA: B/Brisbane/60/08 R3 fusion protein compositions HL169 (○, SEQ ID NO: 147), HL483 (SEQ ID NO: 148) (□, with 9 amino acid linker of SEQ ID NO: 123), and HL611 (SEQ ID NO: 150) (Δ, with a 9 amino acid extension and other negatively charged amino acids of SEQ ID NO: 153).

To complement the TLR5 assay, NIA assays were performed to determine the integrity of HA antigens in the Flu B compositions that contain negative linkers (SEQ ID NOs: 149 for HL610 and 150 for HL611), described supra. As shown in FIG. 6, B/Florida/4/06 R3 compositions of the fusion proteins HL352 (SEQ ID NO: 125) or HL610 (SEQ ID NO: 149) exhibit comparable ability to inhibit antibody neutralization. As shown in FIG. 7, B/Brisbane/60/08 R3 compositions of the fusion proteins HL169 (SEQ ID NO: 147), HL483 (SEQ ID NO: 148), and HL611 (SEQ ID NO: 150) also show similar integrity of the neutralizing epitopes. These results indicate that influenza B portions of HA globular heads fused to a loop of domain 3 of flagellin are folded similarly and present epitopes in a conformation similar to that of the wild type virus. Given this similarity, the difference in the ability of fusion proteins described herein, such as FluB antigens fused to a loop of domain 3 with or without a 9 amino acid extension (SEQ ID NO: 123) or with or without an additional three negatively charged amino acid residues corresponding to amino acid residues of the naturally occurring HA, to trigger TLR5 signaling becomes critical to determine the fusion protein potency.

Example 3

Fusion Proteins with HA Antigen Inserted into Loop Regions of Domains 1, 2, or 3 of Flagellin to Shift pI to Target Influenza B Although negative charges in the linker regions improved the TLR5 signaling, the immunogenicity of these fusion proteins (SEQ ID NOs: 149 and 150) remained suboptimal, especially for Victoria lineages, such as B/BR. The negative linker may only locally adjust the orientation of HA head with respect to flagellin, which may not be sufficient to allow the formation of 2:2 heterodimers that are critical to initiate a TLR5 signaling cascade. As described below, a portion of an HA globular head was positioned further away from domain 1 of flagellin, the TLR5 binding domain. For example, as depicted in FIG. 14, domain 1 of S. typhurium FliC flagellin is between amino acid residues 47-176 of SEQ ID NO: 2 (amino-domain 0) and amino acid residues 415-464 of SEQ ID NO: 2 (carboxy-domain 0). Fusion protein constructs (HL656, SEQ ID NO: 151, D3Ins of B/FL and HL657, SEQ ID NO: 128, D3Ins of B/BR) were created by fusion of a portion of the globular head of HA antigen into domain 3 of flagellin, which are referred to as domain 3 insertions ("D3Ins").

Figure 8A:
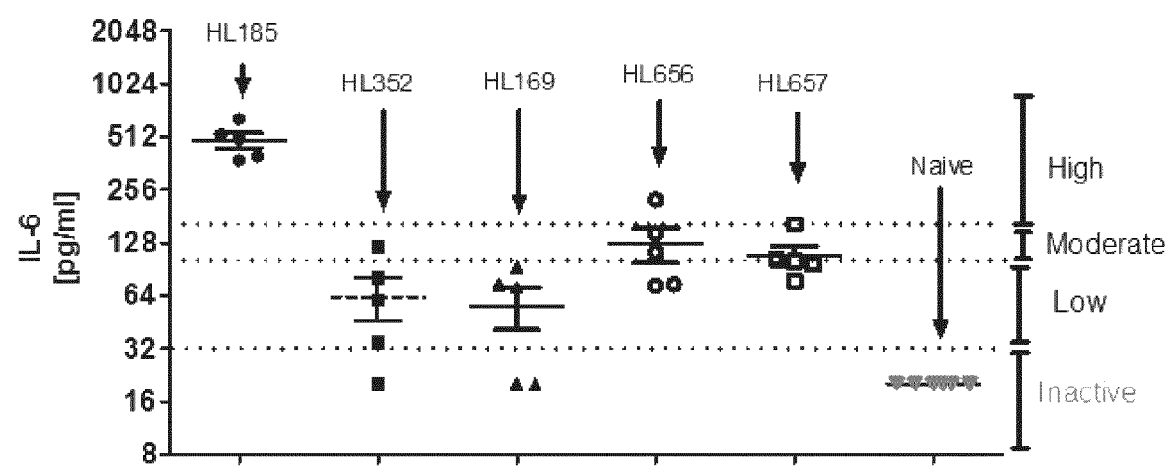
FIGS. 8A and 8B show in vivo TLR5 stimulated cytokine production: Comparison of fusion protein compositions: B/FL (Yamagata lineage) R3.HA B (■, HL352, SEQ ID NO: 125) and D3Ins.HA B (▲, HL656, SEQ ID NO: 151) and B/BR (Victoria lineage) R3.HA B (▲, HL169, SEQ ID NO: 147) and D3Ins.HA B (▼, HL657, SEQ ID NO: 128). R3.HA1 (●, HL185, SEQ ID NO: 143) was included as a positive control. Dotted lines indicate thresholds of cytokines levels correlated with immunogenicity. IL-6 (A) and TNF (B) levels of individual mice are shown, along with bars representing the mean and standard error.
Figure 8B:
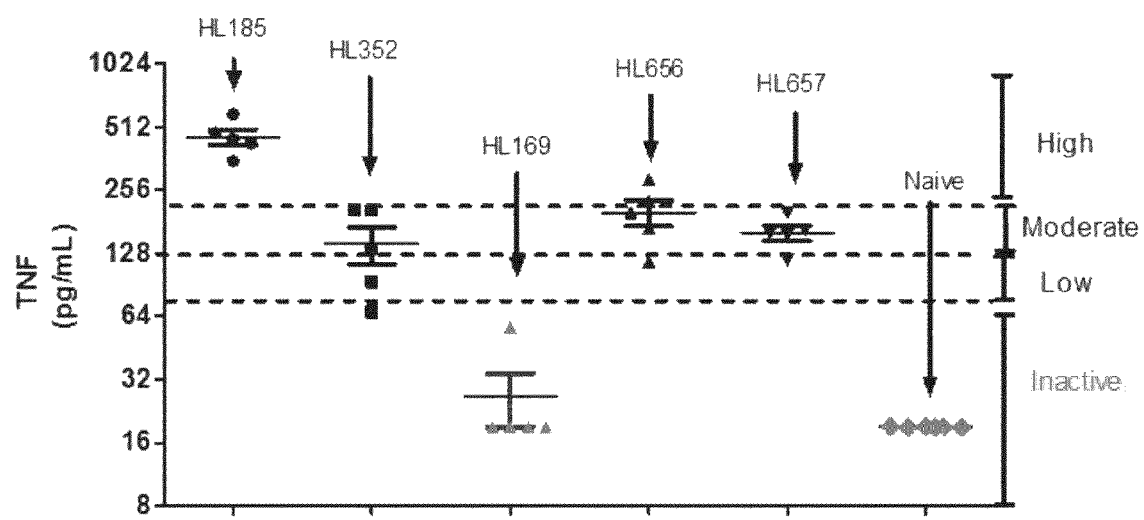
Figure 9A:
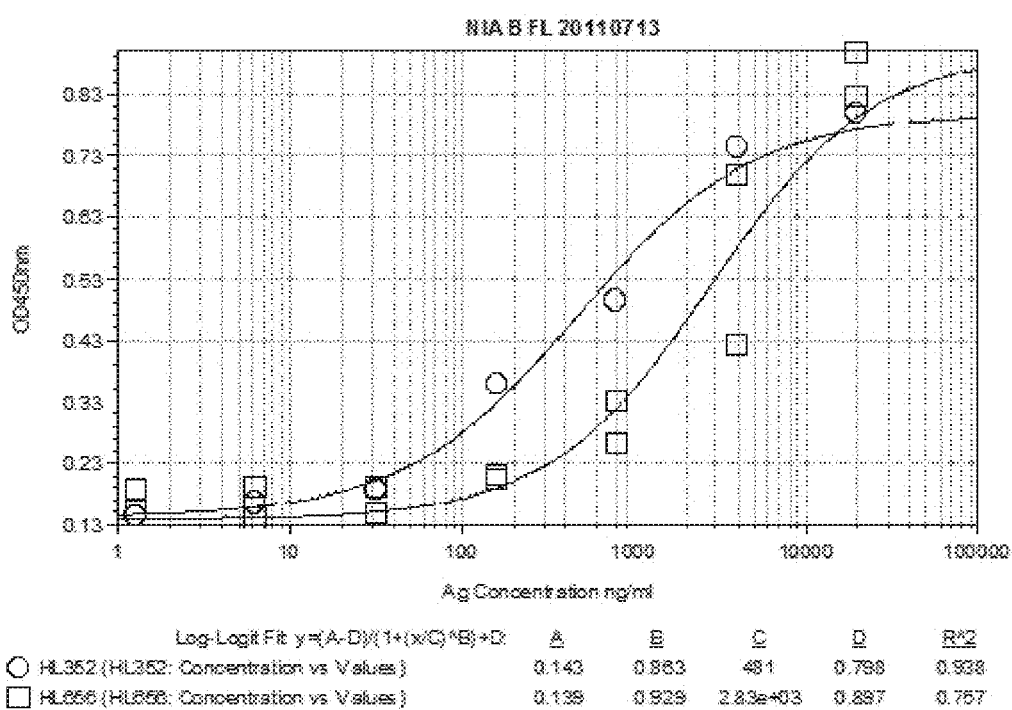
FIGS. 9A through 9C show a comparison of NIA activities of fusion protein compositions of B/Florida/4/06 (○, HL352, SEQ ID NO: 125 and □, HL656, SEQ ID NO: 151) (A), B/Brisbane/60/08 (□, HL611, SEQ ID NO: 150 and ○, HL657, SEQ ID NO: 128) (B), or B/Wisconsin/1/10 (▲, HL724, SEQ ID NO: 152 and ○, HL772, SEQ ID NO: 126) (C).
Figure 9B:
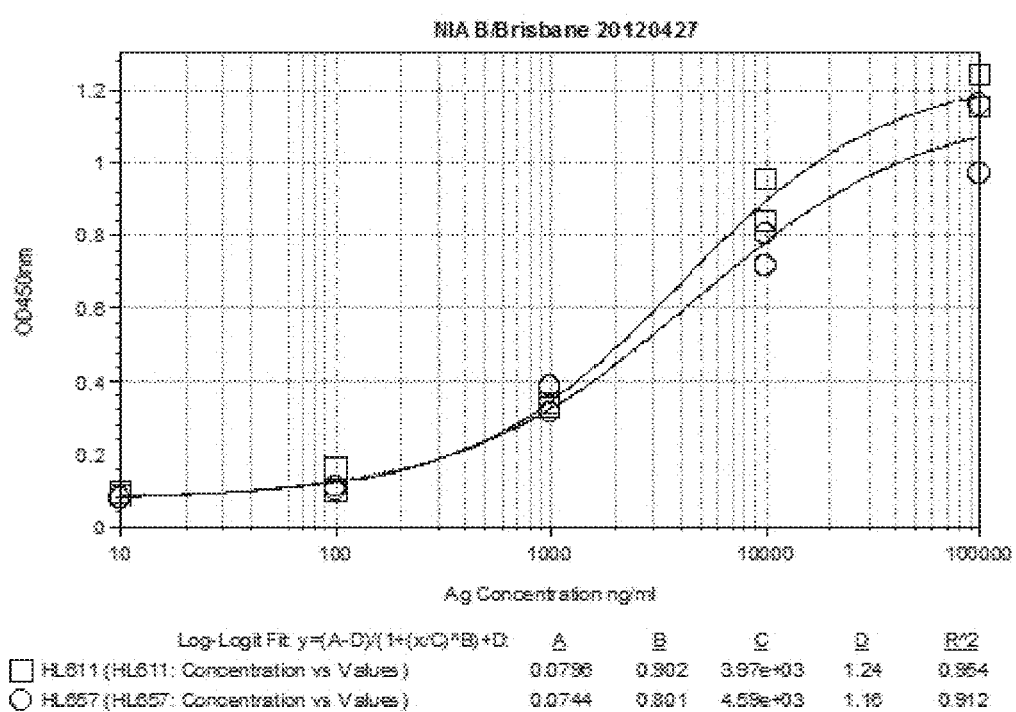
Figure 9C:
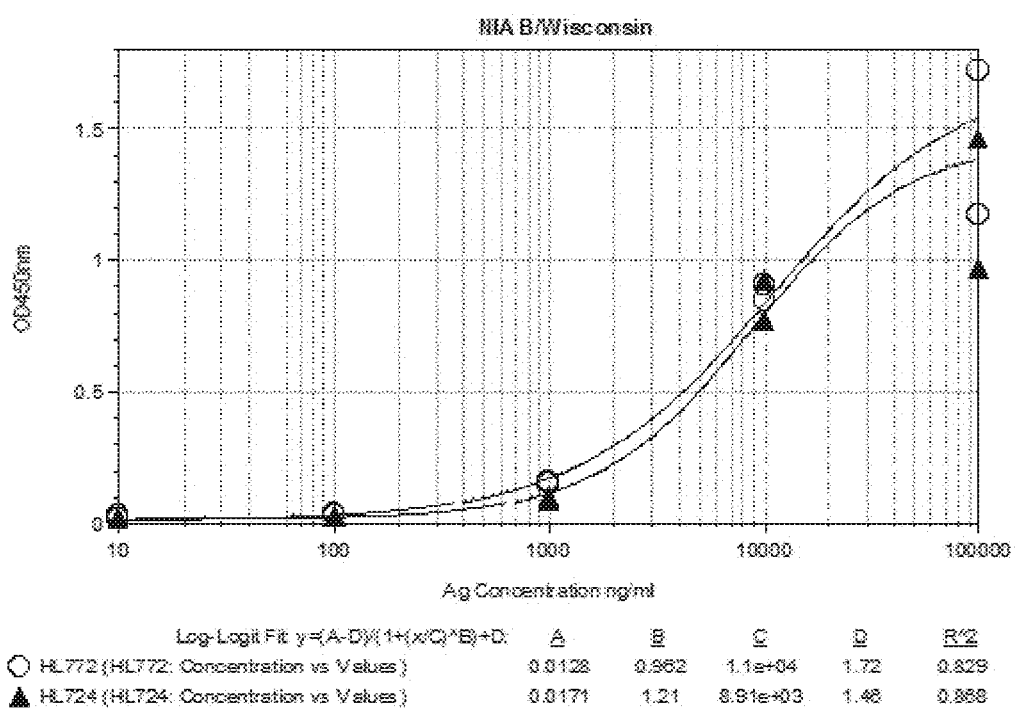

As shown in FIGS. 8A and 8B, more favorable cytokine profiles were observed with the D3Ins fusion protein as assessed by in vivo TLR5 assays. As described above, Balb/c mice were left naïve (♦) or injected with the indicated composition candidate, at about a 1 µg dose: B/FL (Yamagata lineage) R3.HA B (■, HL352, SEQ ID NO: 125) and D3Ins.HA B (▲, HL656, SEQ ID NO: 151), B/BR (Victoria lineage) R3.HA B (▲, HL169, SEQ ID NO: 147) and D3Ins.HA B (▼, HL657, SEQ ID NO: 128). R3.HA1 (●, HL185, SEQ ID NO: 143) was included as a positive control. Fusion proteins generated by removal of domain 3 of flagellin and replacement with a portion of an HA globular head, referred to as "R3" fusion proteins (e.g., R3.HAB) were made employing previously described methods (see, for example, U.S. application Ser. No. 12/905,584). NIA assay did detect an appreciable difference between D3Ins fusion protein and the R3 fusion protein, indicating the antigen retained similar integrity in both formats (FIGS. 9A-9C). The NIA assay assesses the functionality of the portion of the globular head of HA.

Figure 10:
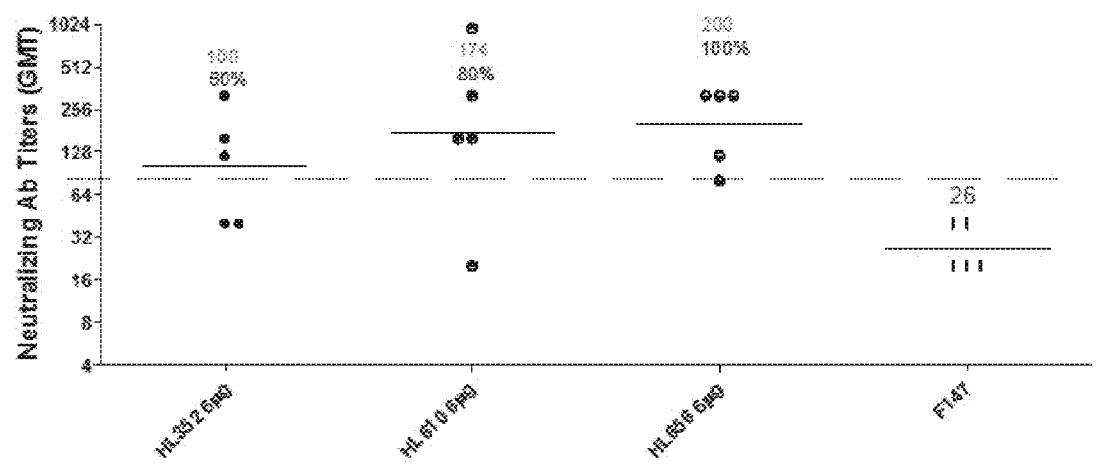
FIG. 10 shows D3Ins B/Fl composition elicits better MN titers than fusion proteins that include HA fused to R3 formats of flagellin: HL352 (SEQ ID NO: 125) (●, R3 with 9 an extension of SEQ ID NO: 123), HL610 (SEQ ID NO: 149) (○, R3 with 9 amino acid linker and additional negatively charged amino acids of SEQ ID NO: 153), or HL656 (SEQ ID NO: 151) (○, D3Ins with 9 amino acid linker of SEQ ID NO: 123). Data are shown as titers of individual mice with GMTs and seroconversion rates (percent (%) mice with a MN titer greater than about or equal to 80) above each group.

The NIA assay was performed as described above using about a 1:1 ratio of serially diluted test articles B/Florida/4/06 (○, HL352, SEQ ID NO: 125 and □, HL656, SEQ ID NO: 151) (FIG. 9A); B/Brisbane/60/08 (□, HL611, SEQ ID NO: 150 and ○, HL657, SEQ ID NO: 128) (FIG. 9B); or B/Wisconsin/1/10 (▲, HL724, SEQ ID NO: 152 and ○, HL772, SEQ ID NO: 126) (FIG. 9C) mixed with sheep anti-HA of B/Florida/4/06 serum (A), B/Brisbane/60/08 (B), or B/Wisconsin/1/10 (C). It is believed that TLR5 signaling plays a more critical role than neutralization inhibition in eliciting protective immune responses. When mice were immunized with a D3Ins fusion protein, D3Ins format compositions including HL610 (SEQ ID NO: 149) (○, R3 fusion protein with 9 amino acid extension and the addition of negatively charged amino acids (SEQ ID NO: 153)) and HL656 (SEQ ID NO: 151) (○, D3Ins with 9 amino acid extension (SEQ ID NO: 123)) elicited stronger immune responses than other fusion proteins, such as HL352 (SEQ ID NO: 125) (●, R3 with the 9 amino acid extension of SEQ ID NO: 123), (FIG. 10). HA352 (SEQ ID NO: 125) is a R3 fusion protein that includes an HA1-2 portion of the globular head of influenza B FL4. Serum antibody titers in FIG. 10 were measured by MN test using B/Florida/4/06 virus antigen. Data are shown as titers of individual mice with GMTs and seroconversion rates (percent (%) of mice with a MN titer≥80) above each group. These data show that the D3Ins format (HL656, SEQ ID NO: 151) was superior to the R3 format for Flu B (HL352, SEQ ID NO: 125).

The immunogenicity of D3Ins fusion proteins listed in Table 3 were evaluated using B/Wisconsin/1/2010, a recently circulating Yamagata lineage strain. In an immunogenicity study, groups of 6 BALB/c mice were immunized with 3 different formats of fusion proteins that include flagellin and portions of the globular head of the HA of Influenza B at a 6 µg dose delivered s.c. in two injections on day 0 and day 21 with the Flu B compositions: R3 B/WI (●, HL719, SEQ ID NO: 154, R3 with negative linker), R3 B/WI (■, HL724, SEQ ID NO: 152, R3 with additional negative charges in the linker), D3Ins B WI (▲, HL772, SEQ ID NO: 126), or F147 buffer (●). Mice were bled on day 35 for HAI titers. Controls included a group immunized with F147 buffer (10 mM L-histidine, 150 mM NaCl, 5% trehalose, 0.02% polysorbate 80, 0.1 mM EDTA, 0.5% ethanol, 10 mM Tris, pH 7.2). All fusion proteins were prepared in F147 buffer. Sera were tested with HAI assays using extracted B/Wisconsin/1/2010 virus antigen. Data are shown as titers of individual mice with GMTs. Statistical differences were determined in 1-way ANOVA/Tukey test with *, p<0.05, ***, p<0.001.

Figure 11:
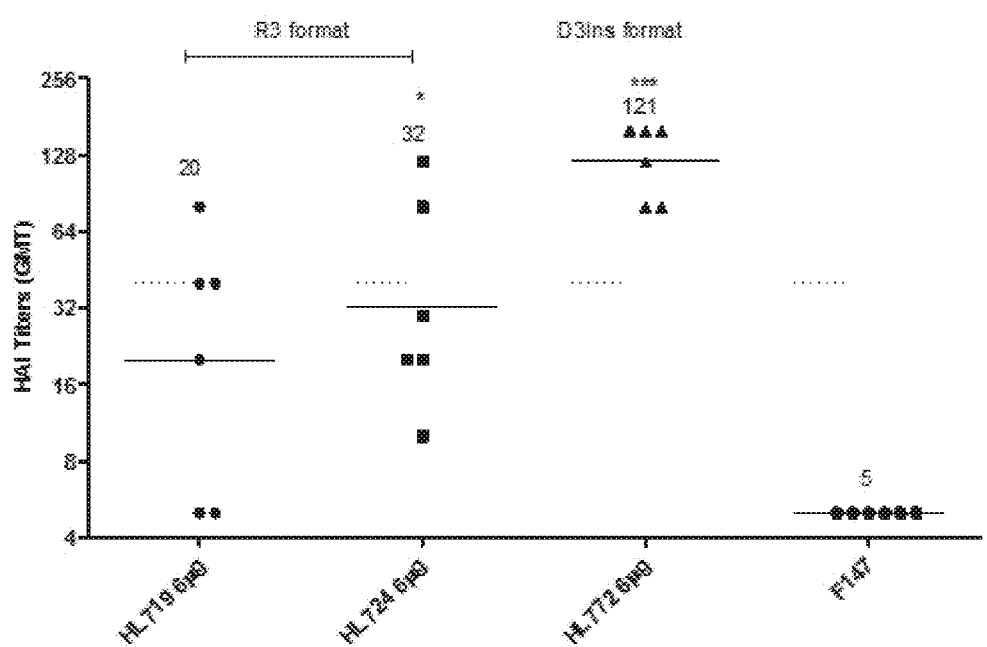

As illustrated in FIG. 11, the highest titers in the monovalent groups were seen with D3Ins fusion protein (HL772, ▲, SEQ ID NO: 126) followed by an R3 fusion protein HL724 (□, SEQ ID NO: 152, B/WI counterpart of B/FL HL610, SEQ ID NO: 149) and HL719 (●, SEQ ID NO: 154, B/WI counterpart of B/FL HL352, SEQ ID NO: 125). Titers of both HL724 (R3 format) and HL772 (D3Ins format) groups were significantly higher than the F147 control. This is consistent with the same formats of B Florida and B Brisbane where the D3Ins was highest, followed by R3 formats (FIG. 10 for B/FL, FIG. 12 for B Victoria lineage, including Brisbane, Hong Kong and Bangladesh). Thus, as predicted by TLR5 data, the D3Ins format improved immunogenicity to the B/WI strain compared to the R3 formats for fusion proteins in mice. A positive immunization control was not included, because the immunogen for B/Wisconsin/1/10 was unavailable at the time of the analysis.

HAI testing of immune sera from a mouse immunogenicity study comparing R3 and D3Ins formats of B Brisbane-like strains was performed. The same modifications were made to the HA antigen (SEQ ID NOS: 95-97), and these antigens were employed in the R3 and D3Ins formats. Groups of 6 BALB/c were immunized s.c. on days 0 and 21 with 6 µg of fusion protein R3 compositions (HL611, SEQ ID NO: 150; HL753, SEQ ID NO: 155; HL742, SEQ ID NO: 156) or fusion protein D3Ins compositions of B/Brisbane/60/08-like viruses (B/Brisbane/60/08 or B/BR, HL657, SEQ ID NO: 128; B/Hong Kong/259/10 or B/HK, HL774, SEQ ID NO: 157; and B/Bangladesh/5945/09 or B/BD, HL787, SEQ ID NO: 158), and bled on day 35. Mice in control groups received 15 µg FLUVIRIN® or F147 buffer. Neutralizing antibody titers of the serum samples were measured by HAI test using ether extracted B/Brisbane/60/08, B/Hong Kong/259/10, or B/Bangladesh/5945/09 virus, and expressed as GMTs. Statistical differences were determined in 2-way ANOVA/Tukey tests with *, p<0.05, **, p<0.01.

Figure 12:
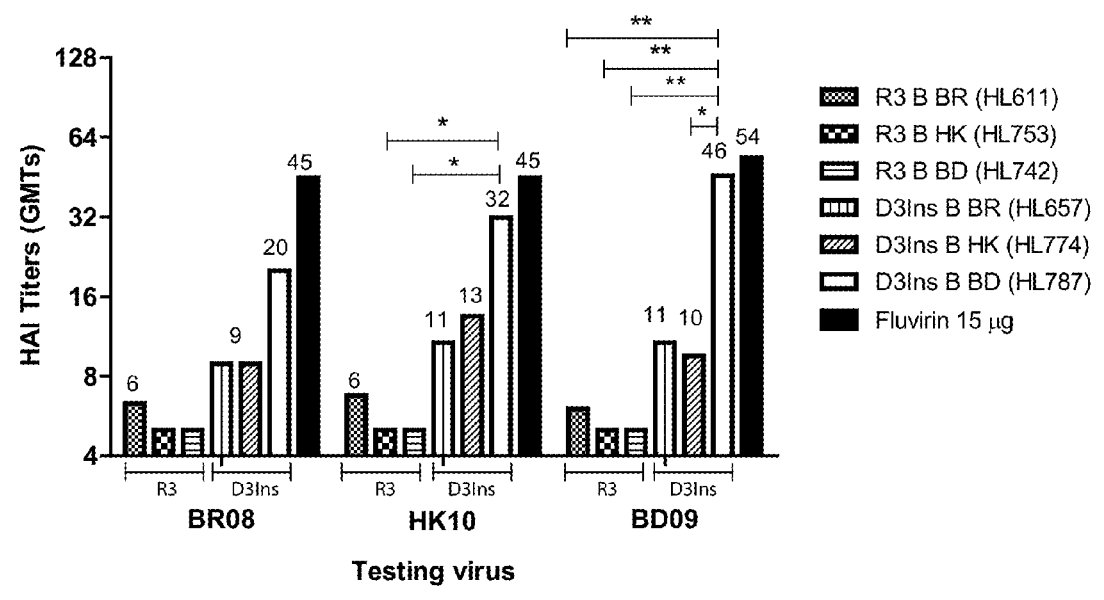

Results of this study indicated that the D3Ins format of B/Brisbane/60/2008-like fusion protein (B/Brisbane/60/08, B/BR SEQ ID NO: 128; B/Hong Kong/259/10, B/HK SEQ ID NO: 157 and B/Bangladesh/5495/09, B/BD SEQ ID NO: 158) elicited significantly higher HAI titers than the strain-matched R3 format measured using 3 different B/Brisbane-like viruses (FIG. 12). D3Ins B/BD (HL787, SEQ ID NO: 158) elicited HAI geometric mean titers comparable to FLU-VIRIN® containing B Brisbane, particularly when B/Hong Kong and B/Bangladesh viruses were used as HAI antigens. These data show that the D3Ins fusion proteins consistently have higher hemagglutination inhibition than R3 fusion proteins across multiple influenza B strains and within a cluster of antigenically similar viruses. Fusion proteins that include portions of the globular head of influenza B fused to a loop of domain 3 of flagellin improved immunogenicity compared to HA portions fused to R3 constructs.

Example 4

Screening the Insertion Variant as a Flu B Fusion Protein

The initial design of the insertion fusion proteins targeted the D3 domain as the insertion site. Three insertion sites (D3I-o1, D3I-i1 and D3I-s1) in loops of domain 3 were selected for fusion of portions of HA antigens (see, for example, FIGS. 29 and 30). In addition to the BNFL fusion protein, B/Wisconsin/1/2010 (B/WI, SEQ ID NO: 263), a currently circulating B Yamagata lineage was chosen to develop seasonal Flu B fusion protein for use in methods of stimulating immune responses. B/BR remains as another candidate in fusion protein development representing another circulating B Victoria lineage Flu B strain. The three constructs of B/WI (HL772, D3I-o1, SEQ ID NO: 126; HL849, D3I-i1, SEQ ID NO: 159; and HL848, D3I-s1, SEQ ID NO: 160) were cloned into the PET24a expression vector, and proteins were purified from E. coli cell culture using standard fermentation as previously described (Song, L., et al., PLoS One 3:e2257 (2008); Song, L., et al., Vaccine 27:5875-5884 (2009)).

Figure 13A:
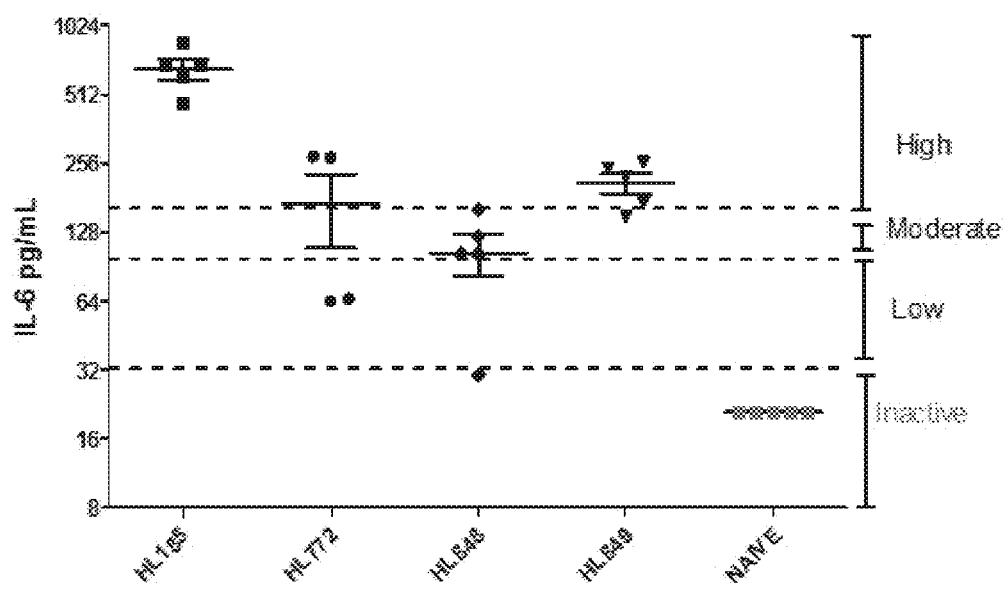
Figure 13B:
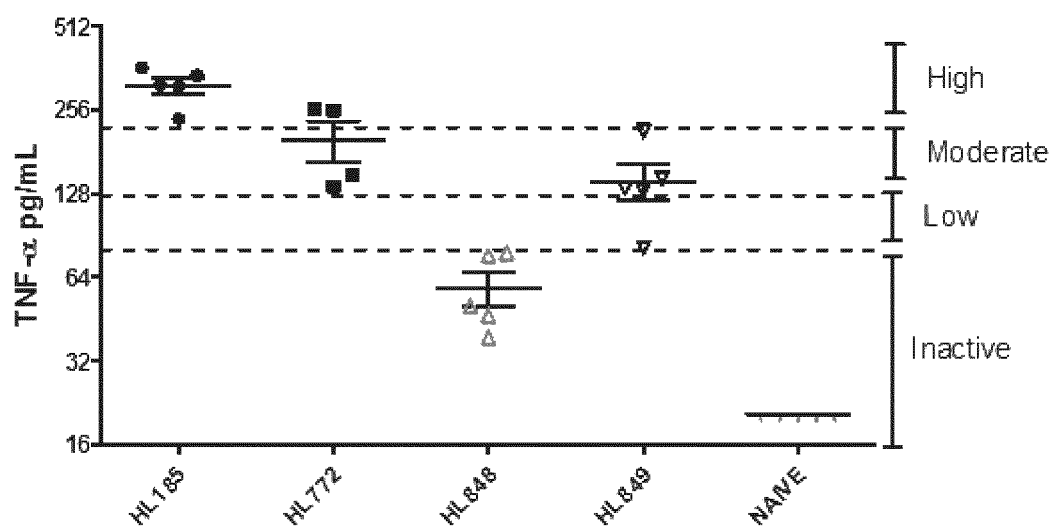

The TNF-α and IL-6 cytokine levels of B/WI constructs are depicted in FIGS. 13A and 13B. The R3 format of H1 CA07 R3.HA1 (HL185, also referred to as "VAX128," SEQ ID NO: 143) fusion protein was used as a positive control. The CA07 vaccine R3.HA1 (HL185, SEQ ID NO: 143) fusion protein has been clinically proven to be safe and immunogenic in humans (Taylor, D., et al., Vaccine 30:5761-5769 (2012) and a strong stimulator of TLR5. The positive controls elicited high levels of TNF-α and IL-6.

The fusion proteins that include an HA antigen fused to a loop of domain 3, B Wisconsin (Yamagata lineage), including HL772 (D3I-o1, SEQ ID NO: 126) and HL849 (D3I-i1, SEQ ID NO: 159), elicited comparable IL-6 levels in the "High" zone with HL848 (D3I-s1, SEQ ID NO: 160) the lowest in the "Moderate" zone. The TNF-α levels for HL772 (D3I-o1, SEQ ID NO: 126) and HL849 (D3I-i1, SEQ ID NO: 159) were lower compared to a positive control but were well above the minimum threshold required to achieve proper immune responses. The fusion protein HL848 (D3I-s1, SEQ ID NO: 160) had TLR5 activity in the "Inactive" zone, indicating the D3I-s1 format may not elicit a strong immune response (FIGS. 13A and 13B). These data show that fusion proteins that include an antigen fused to a loop of domain 3 of flagellin have fewer side effects (are less reactogenic) than fusion proteins that include antigens fused to R3 constructs of flagellin, yet elicit suitable cytokine activity that is critical for immune responses. See Tables 1, 3 and 4 for a list of fusion proteins and sites of insertion in flagellin.

To assess for a fusion protein that maximizes TLR5 signaling and immunogenicity with minimal side effects, loops in domain 2 and domain 1 flagellin, in addition to loops in domain 3 of flagellin, were selected as possible sites of fusion to antigens. The insertion (fusion) sites in flagellin were located in the loop regions so the HA antigen could be inserted without disturbing the overall flagellin structure conformation, including the tertiary structure of domain 3 of flagellin as depicted in FIGS. 14 and 29. The primary amino acid sequence of flagellin indicating the amino acid residues of flagellin between which portions of the globular head of HA from influenza B were fused is depicted in FIGS. 29 and 30. The predicted loops in domains of flagellin is based on a comparison of the known tertiary structure of S. typhimuium FliC flagellin, as discussed supra. Exemplary fusion proteins of the invention include the Yamagata lineage B/Wisconsin/1/2010 listed in Table 3, and Victoria lineage B/Brisbane/60/2008 listed in Table 4.

Table 3. Flu B Yamagata Lineage (B/Wisconsin/)/2010) Fusion Proteins. The fusion protein includes a portion of the globular head of HA (SEQ ID NO: 50) fused to a loop of a domain of S. typhimuium FljB flagellin (SEQ ID NO: 2 or 127).

TABLE 3

| Fusion Protein | SEQ ID NO: | Format | Insertion Site |
|---|---|---|---|
| HL772 | 126 | D3I-o1 | 276-277 in SEQ ID NO: 127 |
| HL656 | 151 | D3I-o1 | 276-277 in SEQ ID NO: 127 |
| HL849 | 159 | D3I-i1 | 259-260 in SEQ ID NO: 2 |
| HL848 | 160 | D3I-s1 | 244-245 in SEQ ID NO: 2 |
| HL825 | 161 | D2I-o1 | 187-188 in SEQ ID NO: 2 |
| HL826 | 162 | D2I-o2 | 178-179 in SEQ ID NO: 2 |
| HL827 | 163 | D2I-o3 | 326-327 in SEQ ID NO: 2 |
| HL828 | 164 | D1I-o1 | 102-103 in SEQ ID NO: 2 |
| HL850 | 165 | D2I-i1 | 366-367 in SEQ ID NO: 2 |
| HL888 | 169 | D3I-o2 | 230-231 in SEQ ID NO: 2 |
| HL890 | 170 | D2I-c1 | 308-309 in SEQ ID NO: 2 |
| HL892 | 171 | D2I-i2 | 388-389 in SEQ ID NO: 2 |

Table 4. Flu B Victoria Lineage (B/Brisbane60/2008) Fusion Proteins. The fusion proteins include a portion of the globular head of HA (SEQ ID NO: 48) fused to a domain of S. typhimuium FljB flagellin (SEQ ID NO: 2, 127, or 270).

TABLE 4

| Fusion Protein | SEQ ID NO: | Format | Insertion Site |
|---|---|---|---|
| HL657 | 128 | D3I-o1 | 276-277 in SEQ ID NO: 127 |
| HL733 | 166 | D2I-o1 | 187-188 in SEQ ID NO: 270 |
| HL856 | 167 | D2I-o1 | 187-188 in SEQ ID NO: 2 |
| HL857 | 168 | D2I-o2 | 178-179 in SEQ ID NO: 2 |
| HL858 | 172 | D2I-o3 | 326-327 in SEQ ID NO: 2 |
| HL860 | 173 | D3I-s1 | 244-245 in SEQ ID NO: 2 |
| HL889 | 174 | D3I-o2 | 230-231 in SEQ ID NO: 2 |
| HL891 | 175 | D2I-c1 | 308-309 in SEQ ID NO: 2 |
| HL893 | 176 | D2I-i2 | 388-389 in SEQ ID NO: 2 |
| HL861 | 180 | D3I-i1 | 259-260 in SEQ ID NO: 2 |
| HL862 | 181 | D2I-i1 | 366-367 in SEQ ID NO: 2 |

Figure 15A:
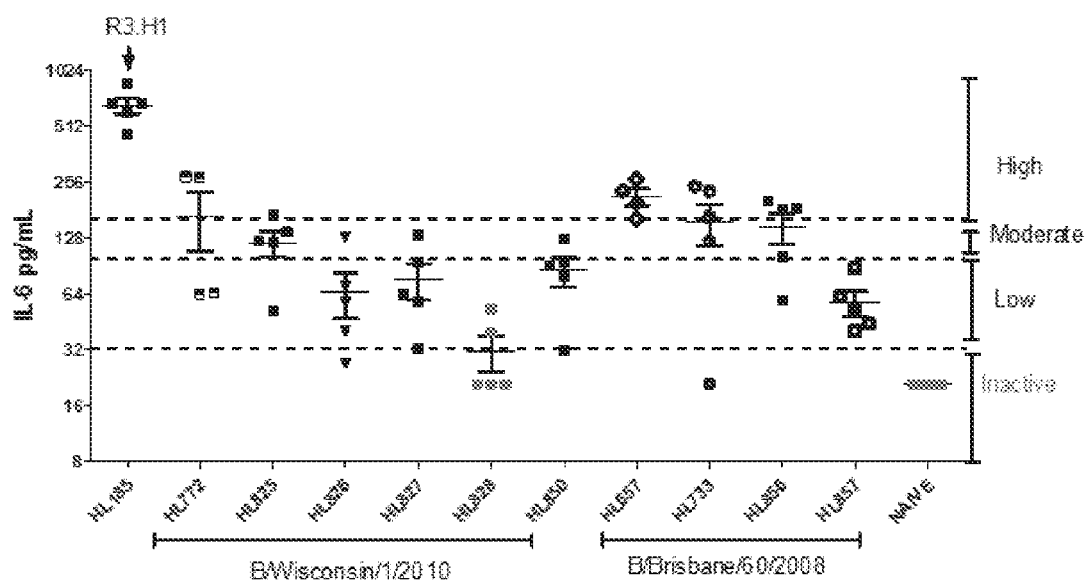
Figure 15B:
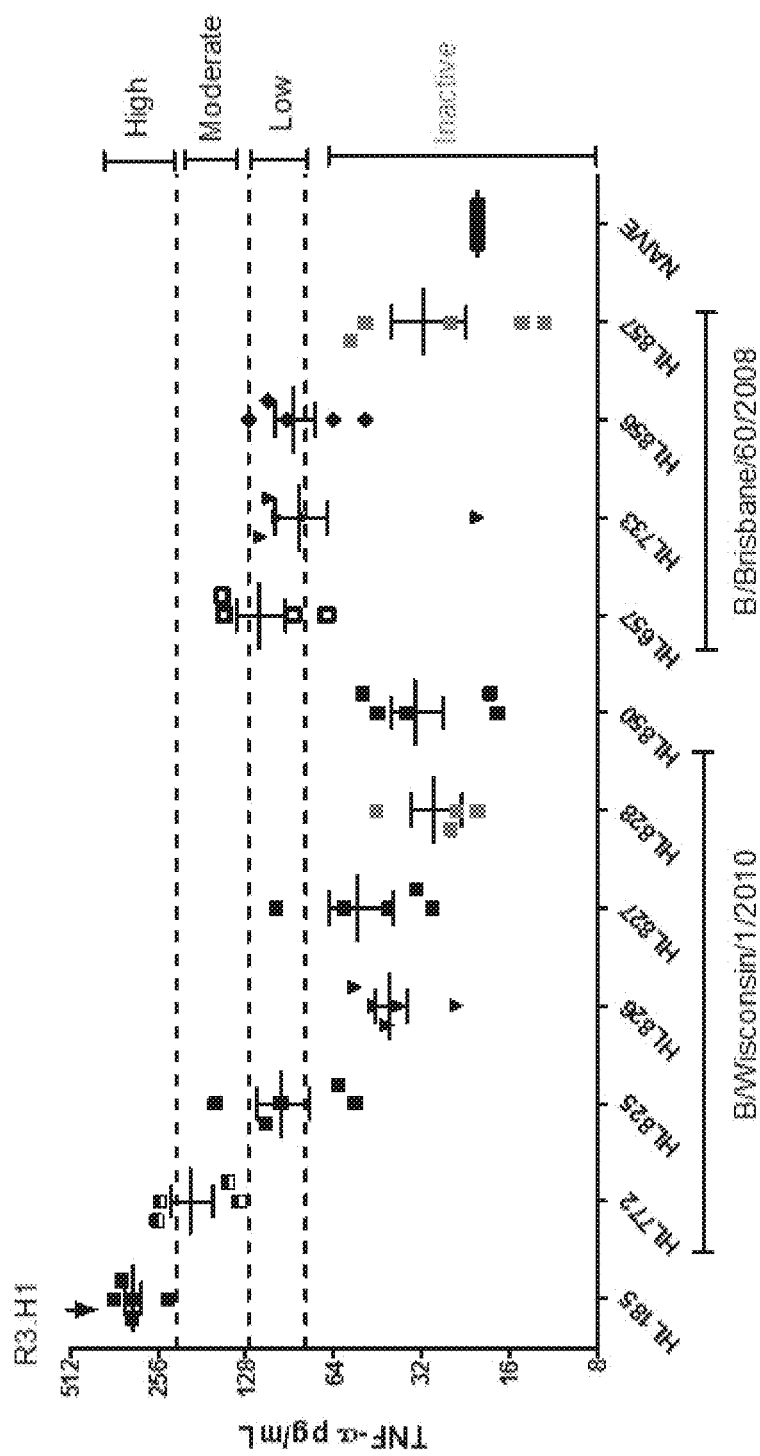

The fusion protein listed in Tables 3 and 4 were evaluated using a TLR5 assay, as described supra. Comparison of fusion proteins with insertions into domain 3 of flagellin (D3I) to insertions into domain 2 of flagellin (D2I) are shown in FIGS. 15A-15B and 16A-16B. The fusion protein constructs used were B Wisconsin (Yamagata lineage) D3I-o1 (HL772, SEQ ID NO: 126), D2I-o1 (HL825, SEQ ID NO: 161), D2I-o2 (HL826, SEQ ID NO: 162), D2I-o3 (HL827, SEQ ID NO: 163), D1I-o1 (HL828, SEQ ID NO: 164) and D2I-i1 (HL850, SEQ ID NO: 165) and B Brisbane (Victoria lineage) D3I-o1 (HL657, SEQ ID NO: 128), D2I-o1 (HL733, SEQ ID NO: 166), D2I-o1 (HL856, SEQ ID NO: 167) and D2I-o2 (HL857, SEQ ID NO: 168) (FIGS. 15A-15B). The fusion protein constructs used were B Wisconsin (Yamagata lineage, FIG. 16A) D3I-o1 (HL772, SEQ ID NO: 126), D3I-o2 (HL888, SEQ ID NO: 169), D2I-c1 (HL890, SEQ ID NO: 170), D2I-i2 (HL892, SEQ ID NO: 171) and B Brisbane (Victoria lineage, FIG. 16B) D3I-o1 (HL657, SEQ ID NO: 128), D2I-o3 (HL858, SEQ ID NO: 172), D3I-s1 (HL860, SEQ ID NO: 173), D3I-o2 (HL889, SEQ ID NO: 174), D2I-c1 (HL891, SEQ ID NO: 175) and D2I-i2 (HL893, SEQ ID NO: 176). R3.HA1 (HL185, SEQ ID NO: 143) was included as a positive control.

These data show that fusion proteins that include antigens fused to loops in domain 3 of flagellin ("D3 insertion constructs," "D3I," "D3Ins," "D3Ins fusion proteins") had enhanced TLR5 activity compared to fusion proteins that include an antigen fused to loops in domain 2 of flagellin ("D2 insertion constructs"). Fusion proteins that include an antigen fused to a loop in domain 1 of flagellin ("D1 insertion constructs") were not active. Among the D3Ins fusion proteins, D3I-o1 (HL772, SEQ ID NO: 21) and D3I-i1 (HL849, SEQ ID NO: 22) were more active than D3I-s1 (HL848, SEQ ID NO: 23) (FIGS. 14-16).

Figure 17:
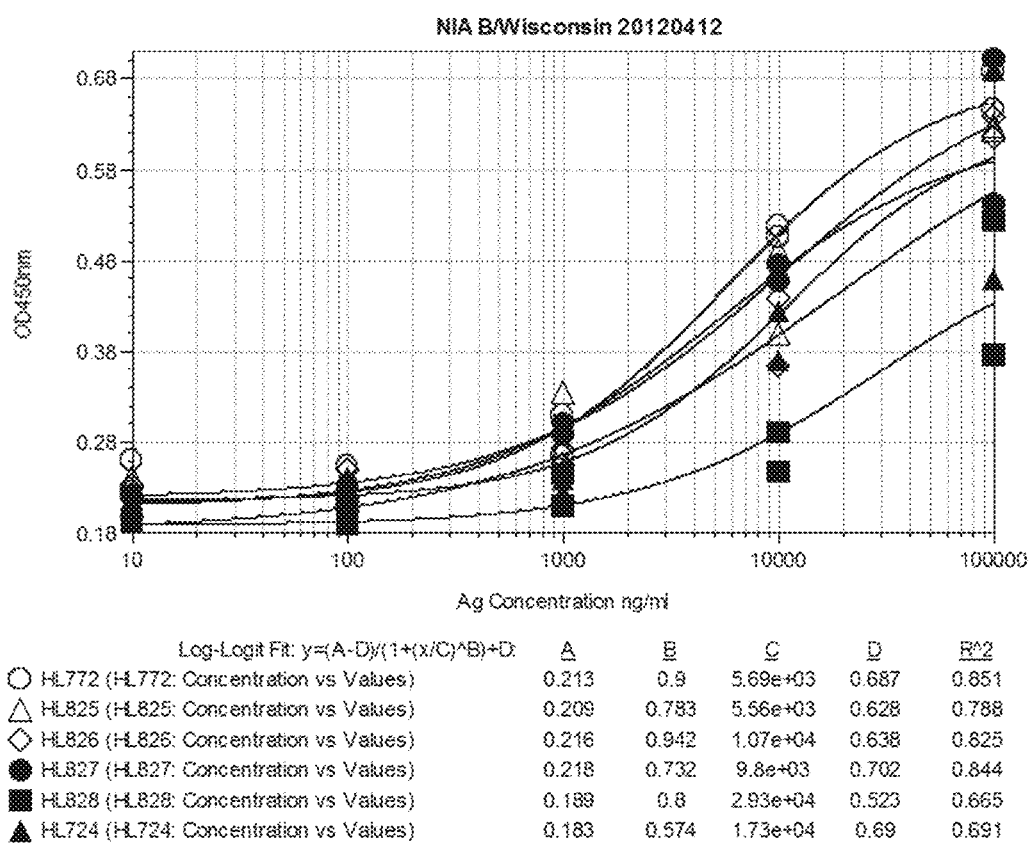

Antibodies generated to fusion proteins having portions of the globular head fused to domain 3, domain 2, or domain 1 were compared for their ability to inhibit virus neutralization in an NIA assay. The NIA assay data for antibodies generated to fusion proteins include (B/Wisconsin/1/2010): D3Ins (○, HL772, D3I-o1, SEQ ID NO: 126), various D2Ins (Δ, HL825, D2I-o1, SEQ ID NO: 161; ◇, HL826, D2I-o2, SEQ ID NO: 162; ●, HL827, D2I-o3, SEQ ID NO: 163), and D1Ins (■, HL828, D1I-o1, SEQ ID NO: 164), in comparison to R3 format (▲, HL724, SEQ ID NO: 152) and are shown in FIG. 17. The NIA assay data for D3I insertion fusion proteins in comparison to the D2I insertion fusion proteins are shown in FIG. 18. The portion of the globular head fused to a loop of domain 2 or a loop of domain 3 is has the same amino acid sequence (SEQ ID NO: 50).

Figure 18A:
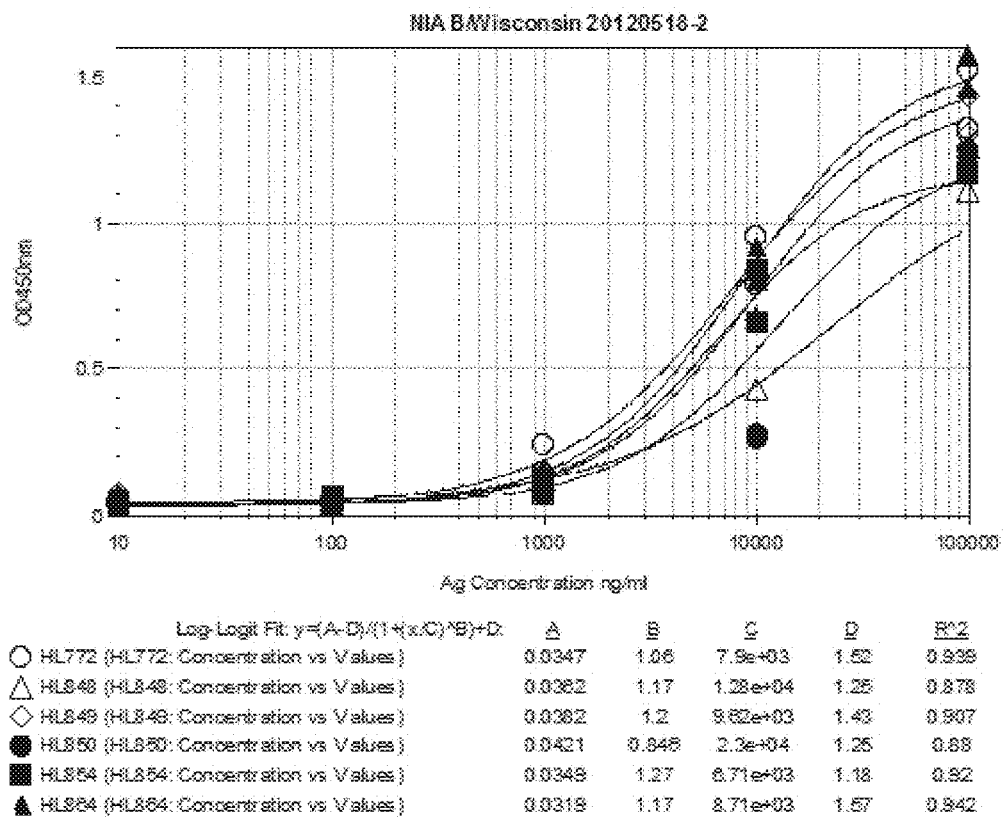
Figure 18B:
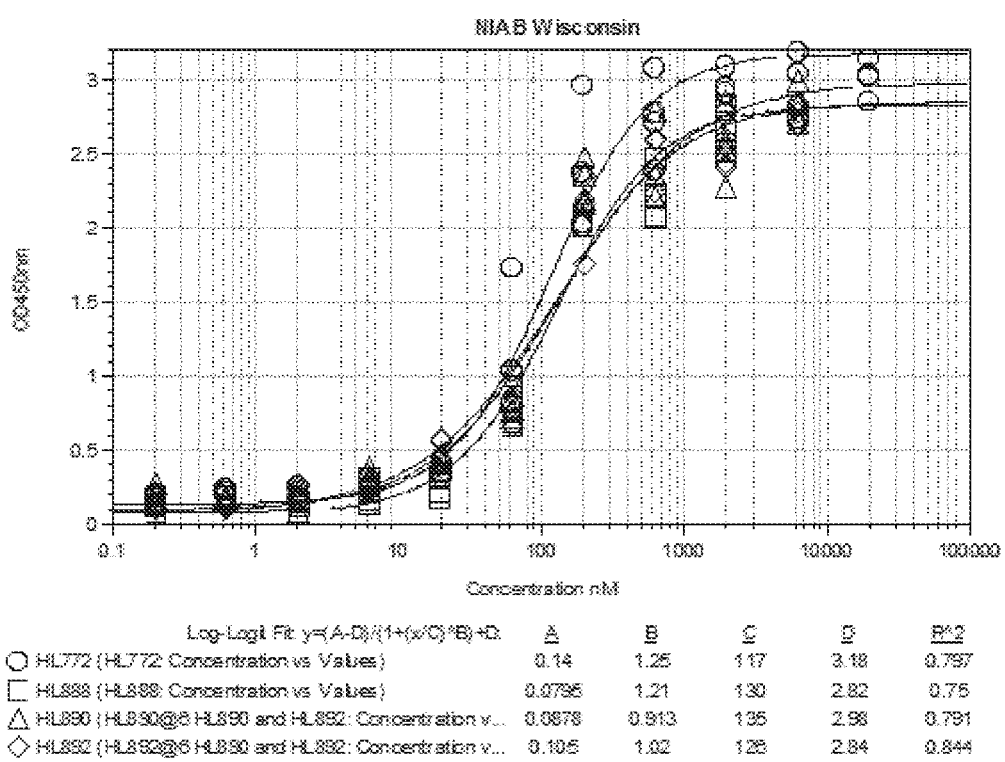

FIG. 18A shows NIA assay data for B/Wisconsin/1/2010 D3I insertion variants: D3I-o1 (○, HL772, SEQ ID NO: 126), D3I-s1 (Δ, HL848, SEQ ID NO: 160), D3I-i1 (◇, HL849, SEQ ID NO: 159), and D3I (▲, HL864, SEQ ID NO: 177), in comparison to the D2I-i1 (●, HL850, SEQ ID NO: 165) and D2I (■, HL854, SEQ ID NO: 179) fusion proteins. FIG. 18A shows the NIA assay data for B/Wisconsin/1/2010 D3I variants: D3I-o1 (○, HL772, SEQ ID NO: 126), D3I-o2 (□, HL888, SEQ ID NO: 169), and D2I-c1 (Δ, HL890, SEQ ID NO: 170), in comparison to D2I-i2 (◇, HL892, SEQ ID NO: 171).

Relatively higher NIA titers were observed with D3 insertion fusion proteins compared to the R3 format as demonstrated by the comparison of HL772 (○, D3Ins, SEQ ID NO: 126) to HL724 (▲, R3, SEQ ID NO: 152) (FIG. 17), indicative of slightly better antigen presentation for D3 insertion format than R3 format. NIA titers indicate that fusion of an antigen to flagellin can deplete serum neutralizing antibodies, which may not correlate with the ability of the fusion protein to generate a protective immune response. The ability to generate a protective immune response includes a balance of the ability of the fusion protein to activate TLR5 and stimulate a sufficient immune response with minimum side effects.

Advantages of fusing antigens to a loop of domain 3 of flagellin by inducing key cytokine secretion in response to immunization is depicted in FIGS. 9A-9C. Taken together, the cytokine and NIA results indicated that the D3 Insertion format of flagellin was a superior format for fusing portion of the globular head of influenza B compared to the R3 format. Furthermore, D3 insertion fusion proteins exhibited higher neutralizating antibody titers compared to D2 insertion fusion proteins. Consistent with the cytokine assay, D1 insertion fusion proteins were inactive in NIA assay. Among three D3 insertion fusion proteins, D3I-o1 and D3I-i1 again demonstrated a greater ability to neutralize viral infection than D3I-s1. The NIA data is consistent with the cytokine activation to assess TLR5 activation.

Figure 19A:
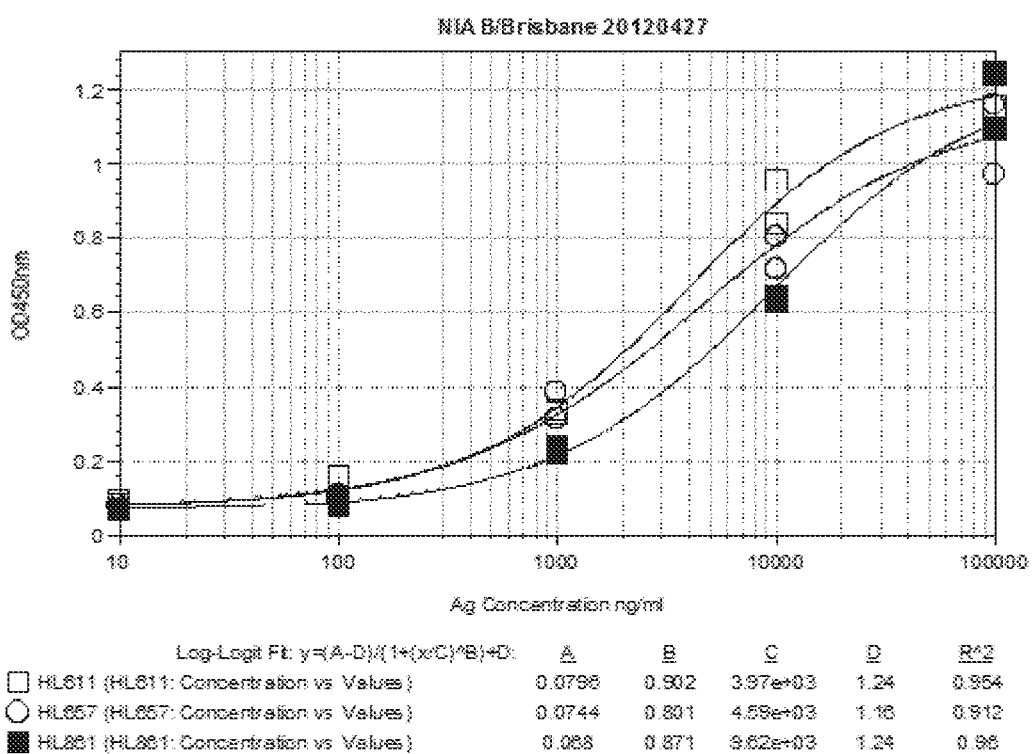
Figure 19B:
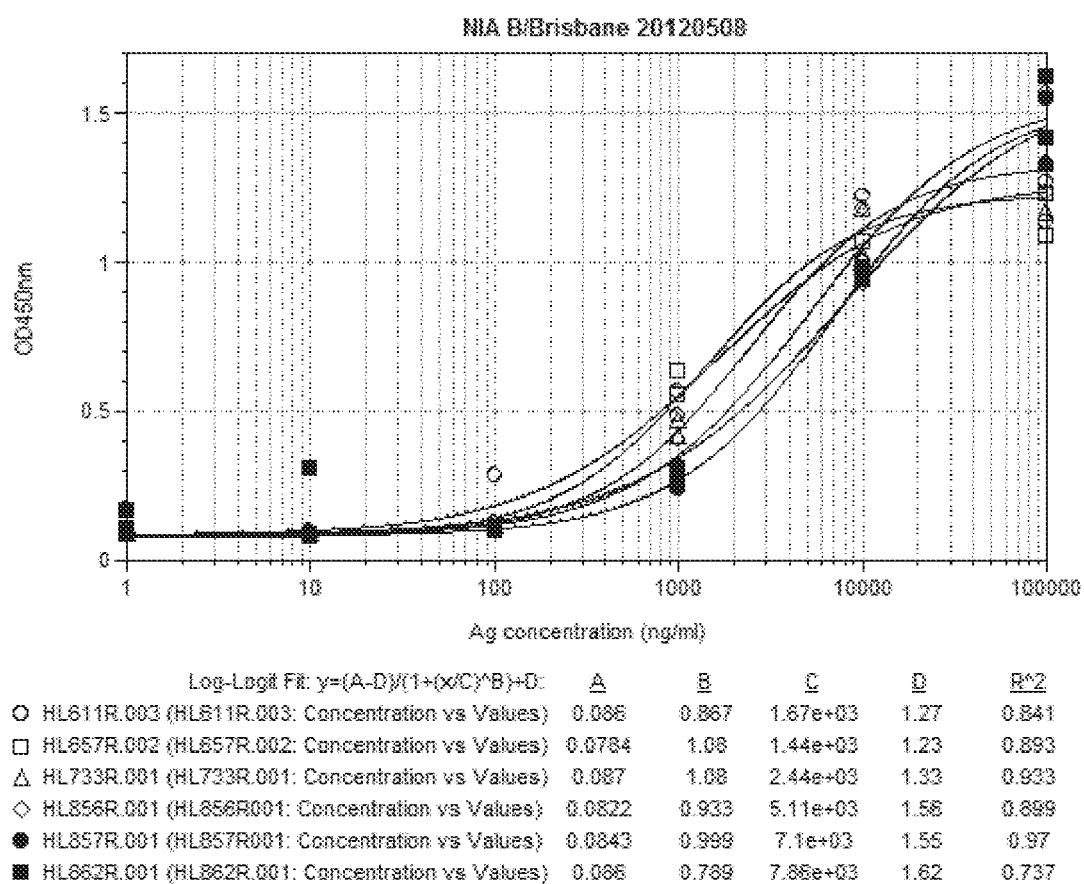
Figure 20:
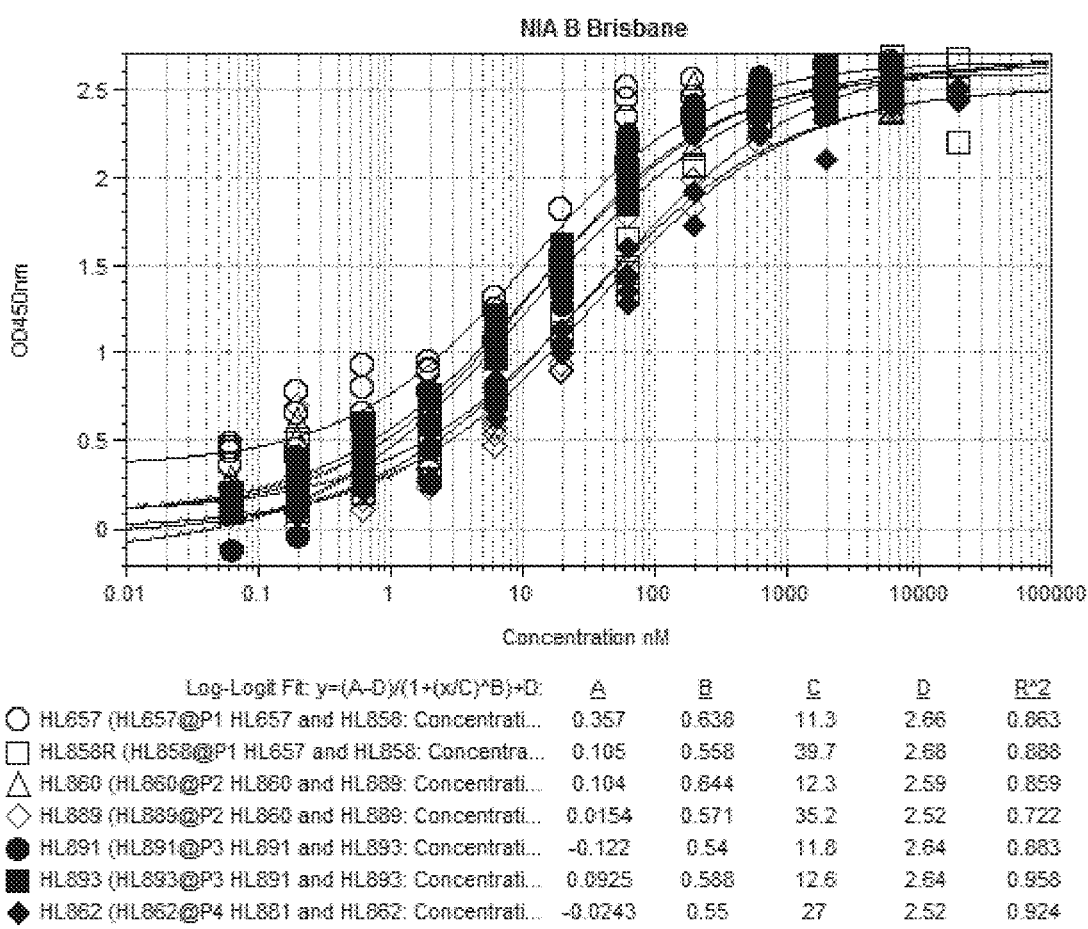

The NIA was employed to evaluate fusion proteins that include portions of the globular head of influenza B for the Flu B Victoria lineage using B/Brisbane/60/2008 as a prototype. The NIA assay data for D3I fusion proteins: D3I-o1 (○, HL657, SEQ ID NO: 128) and D3I-i1 (■, HL861, SEQ ID NO: 180), compared to the R3 (□, HL611, SEQ ID NO: 150) fusion protein are shown in FIG. 19A. FIG. 19B shows the NIA assay data for B/Brisbane/60/2008 R3 (□, HL611, SEQ ID NO: 150) fusion protein in comparison to other fusion proteins in which portions of the globular head are fused to other regions of domain 3, or domain 2: D3I-o1 (○, HL657, SEQ ID NO: 128), D2I-o1 (Δ, HL733, SEQ ID NO: 166), D2I-o1 (■, HL856, SEQ ID NO: 167), D2I-o2 (▲, HL857, SEQ ID NO: 168), and D2I-i1 (♦, HL862, SEQ ID NO: 181). The NIA assay data for D3I fusion proteins: D3I-o1 (○, HL657, SEQ ID NO: 128) and D2I-o3 (□, HL858, SEQ ID NO: 172), in comparison to D2I fusion proteins: D3I-s1 (Δ, HL860, SEQ ID NO: 173), D3I-o2 (HL889, SEQ ID NO: 174), D2I-c1 (HL891, SEQ ID NO: 175), D2I-i2 (HL893, SEQ ID NO: 176), and D2I-i1 (HL862, SEQ ID NO: 181), are shown in FIG. 20.

As shown in FIG. 19A, the D3Ins fusion proteins were comparable to the R3 fusion protein in neutralization inhibition, which indicated similar integrity in both fusion protein formats. When the in vivo cytokine data for the TLR5 test was evaluated, it was determined that the R3 format fusion protein of B/Brisbane/60/2008 was a poor trigger of cytokine release, which is believed to be a key event to elicit an adaptive immune response. Therefore, the D3Ins fusion protein is an exemplary format for Flu B Victoria lineage.

Figure 16A:
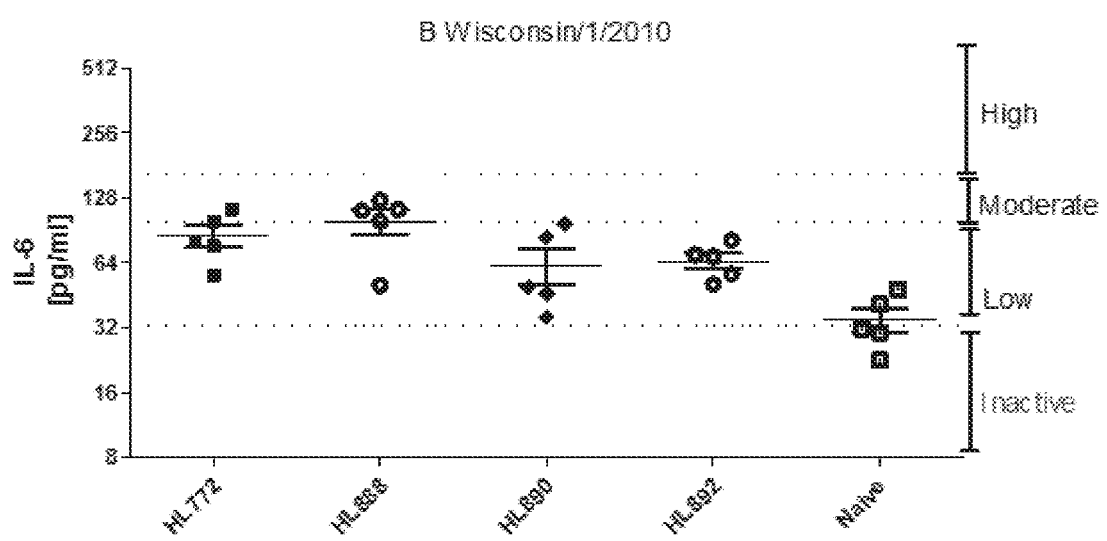
Figure 16B:
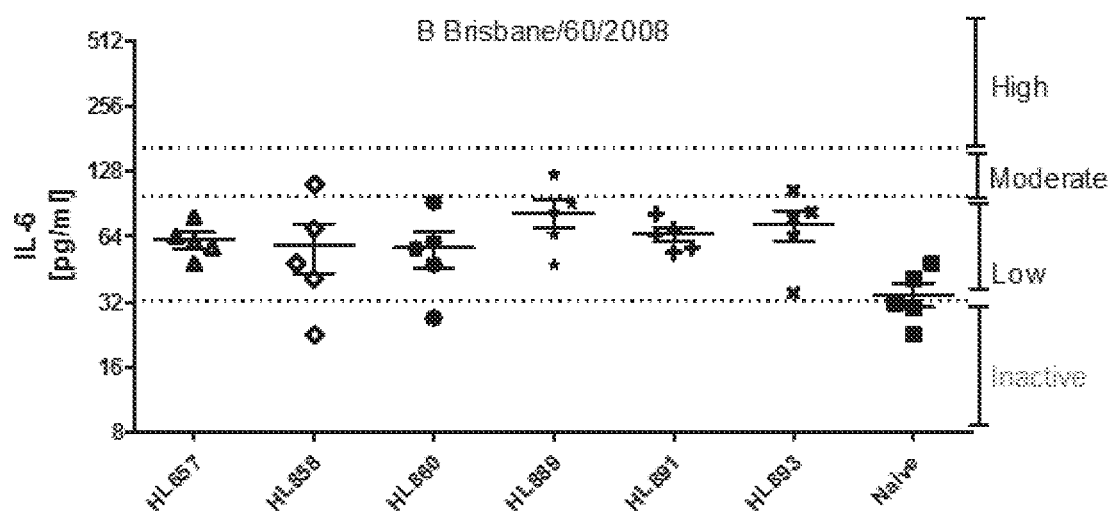

As shown in FIG. 19B, the D2Ins fusion proteins was similar, generating activity slightly lower as compared to D3Ins fusion proteins. However, the TLR5 activity of the D2Ins fusion protein constructs was significantly lower than D3Ins fusion proteins (FIGS. 15A, 15B, and 16B). Consequently, D3Ins fusion proteins, such as HL657 (D3I-o1, SEQ ID NO: 128) and HL861 (D3I-i1, SEQ ID NO: 180), are believed to be better for methods of stimulating an immune response.

In conclusion, fusion of an antigen with an isoelectric point greater than about 7.0 to a loop of domain 3 of flagellin ("D3Ins fusion proteins") can significantly improve TLR5 bioactivity compared to the R3 format. In the NIA functional assay, D3Ins fusion proteins also demonstrated equivalent or greater activity to compete with virus for neutralizing antibodies. D3 insertion format is suitable, for example, as a fusion protein format for use in fusing portions of the globular head of the HA influenza B to flagellin, and is superior to either R3 or D2Ins formats for use with antigens of HA of influenza B, or influenza A antigens that have an isoelectric point greater than about 7.0, such as about 7.5, about 8.0 or about 8.5, about 9.0, about 9.5, about 10.5 or about 11.0.

Example 5

Immunogenicity of Fusion Proteins with HA Antigen Inserted into Loop Regions of Domain 3 of Flagellin to Shift pI to Target Influenza B in a Mouse Model The immunogenicity of three different fusion proteins inserted into three different regions of loops of domain 3 was evaluated in mice. These fusion proteins were D3I-o1, HL772, (SEQ ID NO: 126), D3I-i1, HL849 (SEQ ID NO: 159), and D2I-i1, HL850 (SEQ ID NO: 165) of B/Wisconsin/1/2010 (B/WI). Groups of 8 BALB/c mice were treated i.m. with 2 dose levels (3 μg and 12 μg) of D3I-o1 B/WI (HL772, SEQ ID NO: 126), D3I-i1 B/WI (HL849, SEQ ID NO: 159), and D2I-i1B/WI (HL850, SEQ ID NO: 165) fusion protein on days 0 and 21. All animals were bled on day 35. Serum HAI antibodies were measured by HAI test using ether-extracted B/Wisconsin/1/2010 virus, and horizontal lines represented geometric mean titers (GMTs) (GMT values above the lines above) in FIG. 21A. Seroconversion rates (% of mice showing an HAI≥40) were also given in FIG. 21A as percentages. Statistical differences were determined against F147 buffer control group in ANOVA tests with ***p<0.001.

Figure 21A:
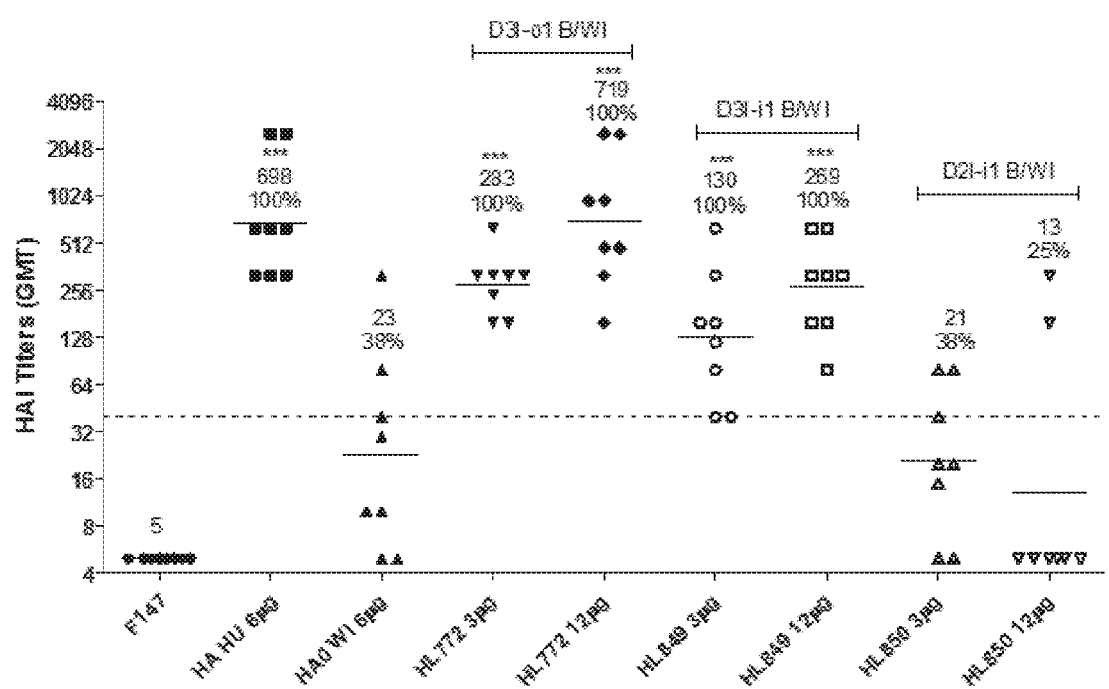

As shown in FIG. 21A, D3I-o1 B/WI elicited about 2-fold higher HAI antibody titers compared to D3I-i1 B/WI. Inactivated virus antigen of B/Hubei-Wujiagang/158/2009 (a B/Wisconsin/1/2010-like virus obtained from CBER, HA HU at 6 μg in FIG. 21A) was used as a positive control and also elicited significant HAI titers. In contrast, D2I-i1 B/WI (HL850) and baculovirus expressed rHA0 of Protein Sciences induced significantly lower HAI titers. Buffer F147 was used as a negative control (FIG. 21A). Therefore, the immunogenicity of three B/Wisconsin/1/2010 fusion proteins ranked as D3I-o1>D3I-i1>D2I-i1, consistent with results from cytokine tests and NIA assays.

Figure 21B:
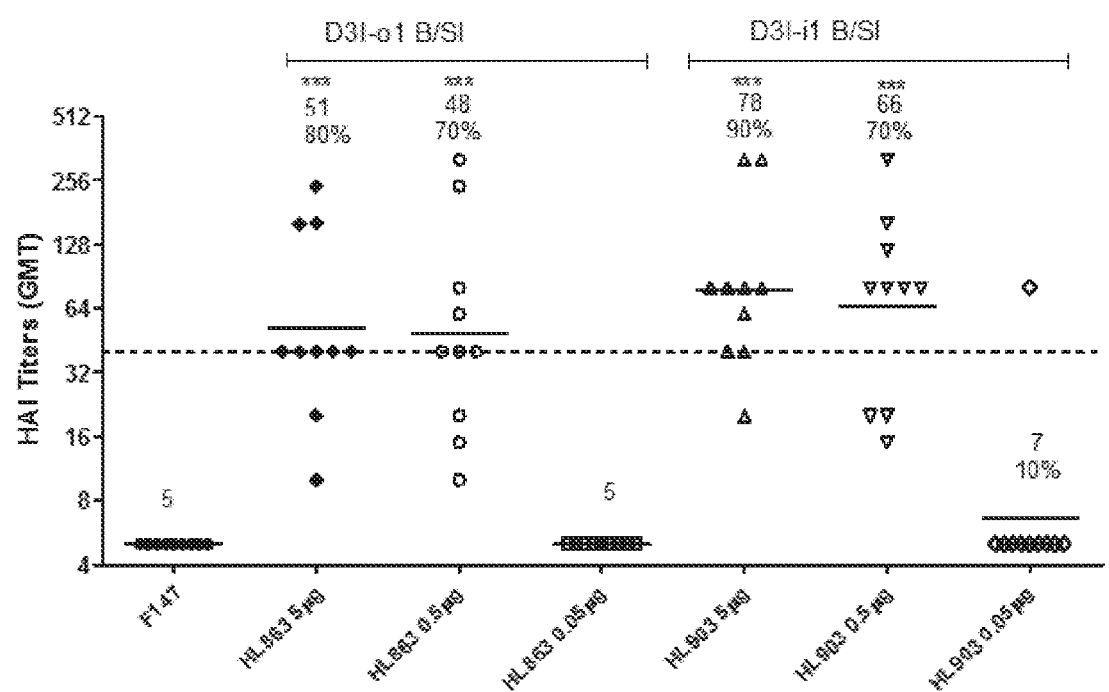

The D3Ins fusion proteins of B/Sichuan/379/1999 (B Yamagata lineage included in 2001/2002 TIV and B/Florida/4/2006 (in 2008/2009 TIV) were also evaluated for immunogenicity as shown in FIG. 21B. Groups of 10 mice were immunized s.c. with 3 different doses (0.05 µg, 0.5 µg and 5 µg) of B/Sichuan/379/1999 D3I-o1 (HL863, SEQ ID NO: 182) or D3I-i1(HL903, SEQ ID NO: 183) fusion protein on days 0 and 21. As shown in FIG. 21B, the D3Ins fusion proteins of B/Sichuan/379/1999 were immunogenic with no statistically significant difference between of or it formats. In general, the D3Ins is more immunogenic than the D2Ins constructs.

Example 6

D3Ins Fusion Protein Format

In order to confirm the general applicability of the D3Ins format of flagellin for use in generating fusion proteins of portions of the globular head of influenza B, fusion proteins for three currently circulating strains in the Yamagata lineage were evaluated in a mouse immunogenicity study. In this study, treatment of groups of 8 BALB/c mice immunized with 2 doses (3 µg and 12 µg) of fusion protein prepared with HA sequence from B/Wisconsin/1/2010 (D3Ins B/WI, HL772, SEQ ID NO: 126); B/Hubei-Wujiagang/158/2009 (D3Ins B/HU HL869, SEQ ID NO: 184); and B/Texas/6/2011 (D3Ins B/TX, HL871, SEQ ID NO: 185). HL869 includes a portion of HA of SEQ ID NO: 58. HL871 includes a portion of HA of SEQ ID NO: 60.

Figure 22:
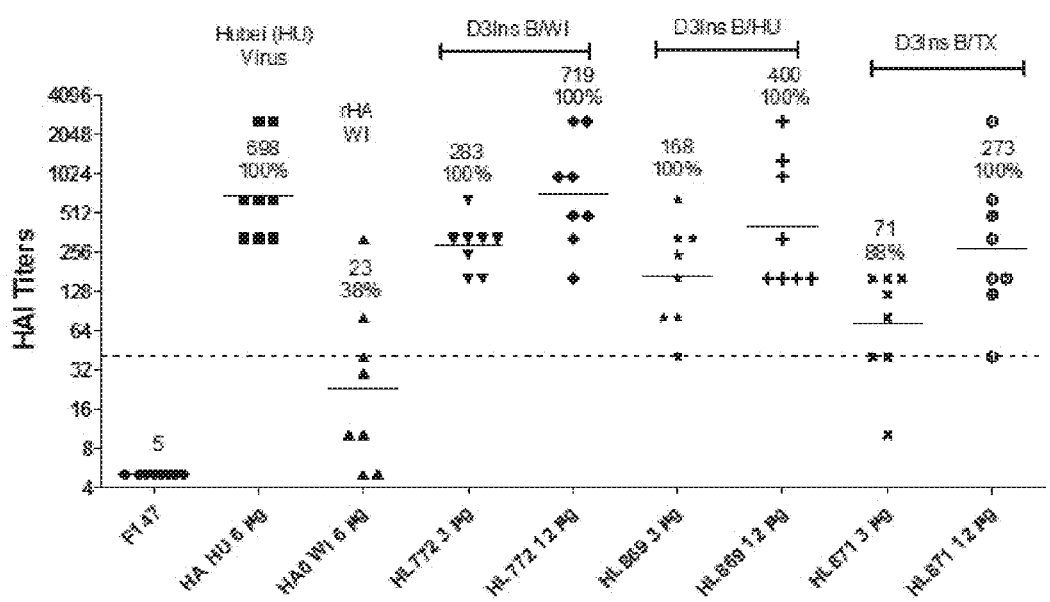

As shown in FIG. 22, the D3Ins fusion proteins of the three strains elicited significant HAI titers (GMTs=71-283 in 3 µg dose groups; 273-719 in 12 µg dose groups). Furthermore, D3Ins B/WI at a 3 µg dose elicited a 12-fold higher geometric mean HAI titer (GMT=283) and a higher seroconversion rate (100%) than those of the baculovirus expressed full length Wisconsin HA (rHA, HA0 WI, Protein Sciences Corporation, Meriden, Conn.) at a 6 µg dose (GMT=23, SC=38%). Therefore, the D3 insertion format fusion protein that includes a portion of the globular head of influenza B Wisconsin (SEQ ID NO: 126) was more immunogenic in mice than the rHA WI (Protein Sciences) and was comparable to the inactivated B/HB virus antigen (obtained from CBER).

Multiple Victoria lineage strains were also evaluated. In particular, the Brisbane-like strains that were recommended for 2009-2011 trivalent influenza vaccines and are still recommended for a quadrivalent influenza vaccine in 2013-14 were evaluated. Having previously demonstrated improved potency of the B Brisbane-like strain B/Bangladesh/5945/2009 in mice, the immunogenicity of the Victoria prototypic fusion protein was evaluated in the rabbit model. Six NZW (New Zealand White) rabbits (3 of each gender) were treated i.m. with the indicated doses (6 µg, 12 µg, and 15 µg) of fusion proteins that include an antigen fused to a loop of domain 3 for either B/Brisbane/60/2008 (SEQ ID NO: 264) or B/Bangladesh/5945/2009 (SEQ ID NO: 265). FLUVIRIN® 2011-12 (TIV, 15 µg total) was included as a positive immunogenicity control, and F147 buffer was included as a negative control. HAI titers were performed with ether-extracted virus matched to the composition: CBER anti B/Brisbane/60/2008 1:5,120 or ferret anti B/Bangladesh/5945/2009 1:10,240. Data were shown as titers of individual rabbits with bars.

Figure 23:
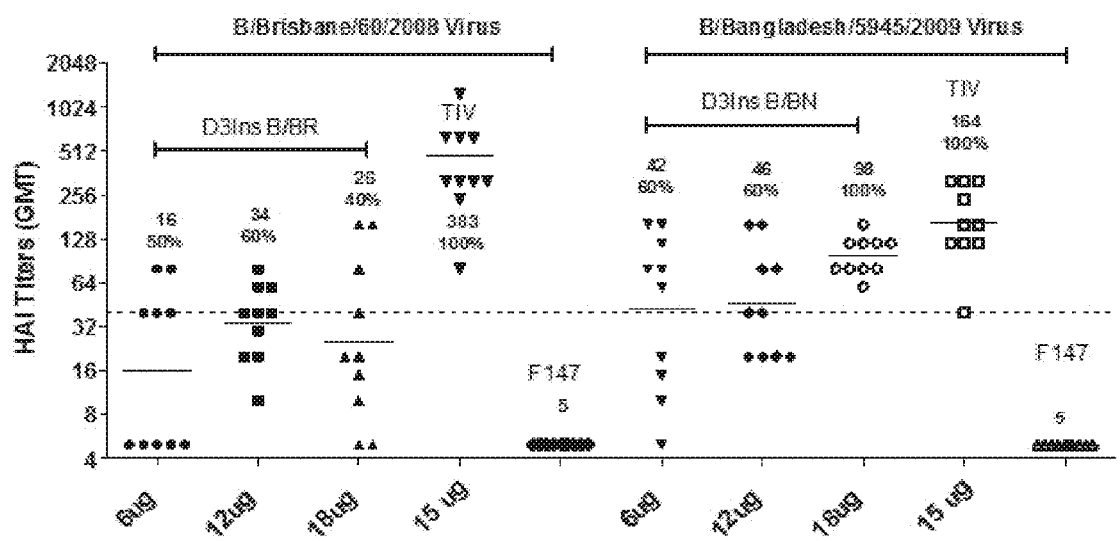

Horizontal lines represented geometric mean titers (GMT values above), and seroconversion percentage was provided in FIG. 23. As shown in FIG. 23, the Bangladesh fusion protein (HL787, SEQ ID NO: 158) was more immunogenic than the Brisbane fusion protein (HL657, SEQ ID NO: 128), with 100% seroconversion, when tested with the matched virus. The Brisbane-like Bangladesh strain, (D3Ins B/BR-like) as the Victoria lineage candidate may be useful in methods of providing protective immunity.

Figure 24:
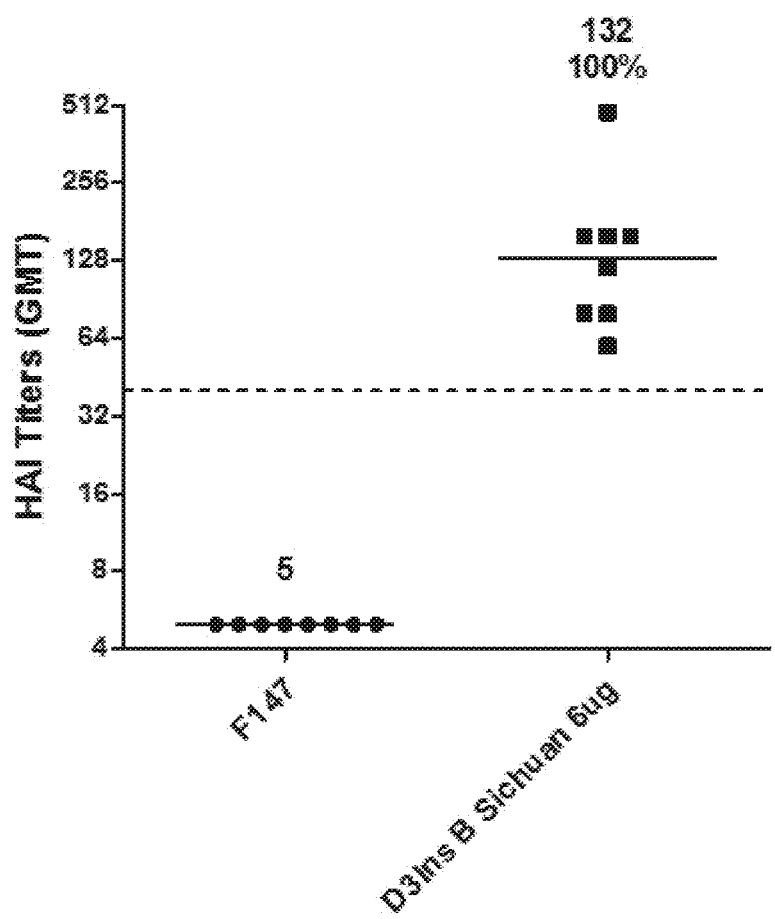

Fusion proteins of antigens fused to a loop of domain 3 were further evaluated for suitability across at least three recent and historical strains. Consistent with this strategy, testing of historical B candidates was carried out using D3Ins format of B/Sichuan/379/1999, a historical flu B virus (Yamagata lineage, STF2D3Ins B/SI, HL863, SEQ ID NO: 182). The portion of HA fused to the D3-o1 site (see loop 6 of FIGS. 29 and 30) is SEQ ID NO: 56. HAI testing of mouse immune sera raised against B/Sichuan/379/1999 virus was performed. In this experiment, groups of 10 BALB/c mice were treated s.c. twice on days 0 and 21 with the STF2D3InsB/SI (HL903, SEQ ID NO: 183) fusion protein at a dose of 6 µg or with formulation buffer (F147). Mice were bled on day 35. Serum HAI antibodies were measured using ether-extracted B/Sichuan/379/1999 virus, and values were plotted individually with GMTs and seroconversion indicated above. The immunogenicity results in FIG. 24 showed that the D3Ins composition of B Sichuan (SEQ ID NO: 182) at a 6 µg dose elicited a GMT of 132 with a seroconversion rate of 100%. These data show that the D3Ins is suitable for use in generating compositions that include fusion protein of flagellin and portions of the globular head of influenza B for use in methods to treat seasonal exposure to influenza.

Example 7

Efficacy of Fusion Proteins with HA Antigen Inserted into Loop Regions of Domain 3 of Flagellin to Shift pI to Target Influenza B in Mice In addition to immunogenicity testing of the D3Ins fusion proteins of the historical B virus, B/Sichuan/379/99 (D3Ins B/SI, HL863, SEQ ID NO: 182, Yamagata lineage) described above, efficacy testing in a lethal mouse challenge model was evaluated. Groups of 10 BALB/c mice were treated s.c. with the indicated doses (0.05 µg, 0.5 µg, and 5 µg) of D3Ins B/SI 99 (HL863, SEQ ID NO: 182) fusion protein or F147 buffer control on days 0 and 21, and bled on day 35. On day 42, mice were challenged intranasally with $5 \times LD_{50}$ of B/Sichuan/379/1999 $10^5$ pfu per mouse and monitored daily for mortality for 21 days and weight change for 14 days.

Survival rates and weights (mean percentage of initial weight) were plotted in FIGS. 25A-25B. Doses of about 5 µg and about 0.5 µg fusion protein D3Ins B/SI composition (two immunizations each) resulted in a 100% survival rate and about less than 12% weight loss in mice challenged with a lethal dose of B/Sichuan/379/99 virus (FIGS. 25A-25B). In contrast, the placebo group showed about a 20% survival rate and greater than or equal to about a 75% weight loss. These results indicated that the D3Ins fusion protein composition of B/Sichuan/379/99 was efficacious at a submicrogram dose. The efficacy of D3Ins B/SI in this study thus supported the general suitability of D3Ins format for use in compositions that include portions of influenza B.

Example 8

Immunogenicity and Safety of Fusion Proteins with HA Antigen Inserted into Loop Regions of Domain 3 of Flagellin to Shift pI to Target Influenza B in a Rabbit Model The immunogenicity of D3Ins fusion proteins was also evaluated in a rabbit model. A rabbit study designed to evaluate the immunogenicity of a range of doses of the R3 and D3Ins formats of B/WI was performed. HAI titers elicited by R3 and D3Ins formats of B Wisconsin in rabbits were measured. Fusion protein R3 B Wisconsin (HL724, SEQ ID NO: 152) and D3Ins B Wisconsin (HL772, SEQ ID NO: 126, a D3I-o1 insertion, see Table 1) doses of 6, 12 and 18 µg were evaluated in groups of 6 New Zealand White rabbits, 3 of each gender (Covance Research Products, Denver, Pa.). For this study, fusion proteins were injected i.m. on days 0 and 21, and serum was collected on day 35 for HAI analysis. A blend of baculovirus produced HA or egg-produced inactivated virus for matching strains (5 µg each) was included as a positive control, and F147 buffer was included as a negative control. HAI titers were performed with ether-extracted B/Wisconsin/1/210 virus.

Data are shown as titers of individual rabbits, values plotted individually with GMTs and seroconversion indicated above (FIG. 26). One of the aims of the study was to confirm that the D3Ins fusion protein format of B/WI (HL772, SEQ ID NO: 126) was superior to the R3 format (HL724, SEQ ID NO: 152). As shown in FIG. 26, the fusion protein R3 format elicited low HAI titers and only achieved a high seroconversion rate (about 67%) at 18 µg with a GMT of about 22. By contrast, the fusion protein D3Ins format generated serconversion rates greater than or equal to about 50% at all three doses with a peak response at 12 µg (about 83%). This result confirmed previous mouse results demonstrating the superiority of the D3Ins format. The HL772 (SEQ ID NO: 126) may be useful in methods of treating subjects to provide protective immunity.

In order to establish a suitable dose range for the rabbit model in terms of safety and immunogenicity, a dose range study with D3Ins B/WI (HL772, SEQ ID NO: 126) was performed. Groups of 10 NZW rabbits (5 of each gender) were treated i.m. with doses (3 µg, 6 µg, 9 µg, 12 µg, 15 µg, and 18 µg) of the STF2D3Ins B/WI (HL772, SEQ ID NO: 126) fusion protein, inactivated B/Hubei-Wujiagang/158/2009 virus (5 µg Hubei virus, CBER), or formulation buffer (F147) on days 0 and 21, and bled on day 35. Serum HAI antibodies were measured by HAI test using ether-extracted B/Wisconsin/1/2010 virus, and plotted individually with GMTs and seroconversion.

The immunopotency results are shown in FIG. 27. Similar to the results with mice, strong HAI titers were elicited by doses in the low to mid microgram range, in this case with seroconversion of 100% occurring at doses as low as about 6 µg. The higher titers observed in this study were likely the result of a higher purity protein preparation. These results indicated that strong influenza B titers can be observed with low doses of the D3 insertion fusion protein that includes an influenza B antigen in multivalent mixes, thereby leading to a low total dose and a suitable safety window for multivalent blends for compositions that can be employed in methods of stimulating an immune response to the antigen, in particular providing protective immunity to a disease causing organism that includes the antigen.

The reactogenicity of D3Ins fusion proteins was examined in a rabbit safety model employing techniques previously been described (Taylor, D. N., et al., *Vaccine* 30:5761-5769 (2012)). In this model, three measures are found to be predictive of the appearance of adverse events in humans: poor appetite (low food consumption) within 24 hours of prime, increase in body temperature 6 hours after prime, and elevated serum CRP 24 hours post-prime.

Rabbits were treated with either formula buffer control (F147) as a negative control, or a fusion protein in which an antigen with an isoelectric point at least about 7.5 (B/Wisconsin/2010) is fused to a loop of domain 3 (HL772, SEQ ID NO: 126) at varying doses (3 µg, 6 µg, 9 µg, 12 µg, 15 µg, and 18 µg). Food consumption was measured about 24 hours after immunization (FIG. 28A). Temperature was measured rectally 6 hours post-immunization (FIG. 28B). CRP was measured from serum taken 24 hours after prime (FIG. 28C). Data for all measures were shown as results of individual rabbits with lines representing means and standard error of the mean. Dotted lines represent the safety threshold calculated using the data from formula control rabbits. Using the mean of the formulation control animals from several studies and using confidence intervals or multiples of standard deviations, safety thresholds were developed for each of the three measures. In this study a range of doses of fusion proteins in which antigens of influenza B of Wisconsin have been fused to loop 6 of domain 3 of flagellin (FIGS. 29 and 30) were evaluated The results show that the highest doses of B Wisconsin were safe to a dose of about 18 µg (D3Ins B Wisconsin, HL772, SEQ ID NO: 126). Doses from about 3 to about 18 µg resulted in little decrease in food consumption (FIG. 28A), with all group means falling within the safe threshold. Similarly, elevation in temperature at about 6 hours was minimal over the tested dose range (FIG. 28B), with all values below the safety thresholds. Finally serum CRP at about 24 hours showed only modest elevation up to about 18 µg (FIG. 28C). It is believed that doses as high as about 18 µg of D3Ins of B Wisconsin may be suitable (i.e., safe) as an influenza B component in a multivalent blend that can be employed in a method to stimulate an immune response to influenza B, in particular a protective immunity response to disease consequent or associated with influenza B infection.

The teachings of all patents, published applications and references cited herein are incorporated by reference in their entirety.

While this invention has been particularly shown and described with references to example embodiments thereof, it will be understood by those skilled in the art that various changes in form and details may be made therein without departing from the scope of the invention encompassed by the appended claims.

SEQUENCE LISTING (288 sequences)

SEQ ID NO: 1 - protein, 494 aa, Salmonella typhimurium
AQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNVQQKYKVSDTAATVTGYADTTIALDNSTFKASATGLGGTDQKIDGDLKFDDTTGKYYAKVTVTGGTGKDGYYEVSVDKTNGEVTLAGGATSPLTGGLPATATEDVKNVQVANADLTEAKAALTAAGVTGTASVVKMSYTDNNGKTIDGGLAVKVGDDYYSATQNKDGSISINTTKYTADDGTSKTALNKLGGADGKTEVVSIGGKTYAASKAEGHNFKAQPDLAEAAATTTENPLQKIDAALAQVDTLRSDLGAVQNRFNSAITNLGNTVNNLTSVRSRIEDSDYATEVSNMSRAQILQQAGTSVLAQANQVPQNVLSLLR

SEQ ID NO: 2 - protein, 506 aa, Salmonella typhimurium
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 3 - protein, 492 aa, Escherichia coli
MAQVINTNSLSLLTQNNLNKSQSSLSSAIERLSSGLRINSAKDDAAGQAIANRFTANIKGLTQASRNANDGISVAQTTEGALNEINNNLQRIRELSVQATNGTNSDSDLSSIQAEITQRLEEIDRVSEQTQFNGVKVLAENNEMKIQVGANDGETITINLAKIDAKTLGLDGFNIDGAQKATGSDLISKFKATGTDNYDVGGKTYTVNVESGAVKNDANKDVFVSAADGSLTTSSDTKVSGESIDATELAKLAIKLADKGSIEYKGITFTNNTGAELDANGKGVLTANIDGQDVQFTIDSNAPTGAGATITTDTAVYKNSAGQFTTTKVENKAATLSDLDLNAAKKTGSTLVVNGATYNVSADGKTVTDTTPGAPKVMYLSKSEGGSPILVNEDAAKSLQSTTNPLETIDKALAKVDNLRSDLGAVQNRFDSAITNLGNTVNNLSSARSRIEDADYATEVSNMSRAQILQQAGTSVLAQANQTTQNVLSLLR

SEQ ID NO: 4 - protein, 488 aa, Pseudomonas aeruginosa
MALTVNTNIASLNTQRNLNASSNDLNTSLQRLTTGYRINSAKDDAAGLQISNRLSNQISGLNVATRNANDGISLAQTAEGALQQSTNILQRIRDLALQSANGSNSDADRAALQKEVAAQQAELTRISDTTTFGGRKLLDGSFGTTSFQVGSNAYETIDISLQNASASAIGSYQVGSNGAGTVASVAGTATASGIASGTVNLVGGGQVKNIAIAAGDSAKAIAEKMDGAIPNLSARARTVFTADVSGVTGGSLNFDVTVGSNTVSLAGVTSTQDLADQLNSNSSKLGITASINDKGVLTITSATGENVKFGAQTGTATAGQVAVKVQGSDGKFEAAAKNVVAAGTAATTTIVTGYVQLNSPTAYSVSGTGTQASQVFGNASAAQKSSVASVDISTADGAQNAIAVVDNALAAIDAQRADLGAVQNRFKNTIDNLTNISENATNARSRIKDTDFAAETAALSKNQVLQQAGTAILAQANQLPQAVLSLLR

SEQ ID NO: 5 - protein, 518 aa, Aquifex aeolicus
MATRINYNYEAAVTYTSLKQNERLMNKSLLRLSTGLRILSAADDASGLFIADQLALVSAGLEQGNRNIQFGISALQIAEGGVSQIYDKLKTMYQKAVSAANDINDPNARAALQRDIENLRDAILKIAQDTEYNGIRLLNGSFNNVRIHYGARSAQTLSVSISSVLPQQLGGYVAEDSPATATDTNNVLTNIGTTNTNYSVASGDSLAFTFTDGTSITFNSLNQLGYDFNNTGTYILDASAIVNTINNNPTLQGKGIRAYAENVSEADLTFDTTNVNIDQGDEVTITFYSGGELVFTKTYTDTVTLDQFIADINNQAGGKLIASKDPSGTKLVLSTPNGETISVEVTVNDADGDTVVSSINLGALLQGAAGTVVNTSGATASAVKVGTLIVMGSENFTVQGTGIAYFTAATSGTFNSLNDVDVTTNKGAEIAQVLIQRAVRQVDTIRTQIGSTINNLQAIYDAQAVAKDNTDNAESIIRNVDFAKEMTEFTKYQIRMQSGVAMLAQANALPQLVLQLLR

SEQ ID NO: 6 - protein, 510 aa, Helicobacter pylori
MAFQVNTNINAMNAHVQSALTQNALKTSLERLSSGLRINKAADDASGMTVADSLRSQASSLGQAIANTNDGMGIIQVADKAMDEQLKILDTVKVKATQAAQDGQTTESRKAIQSDIVRLIQGLDNIGNTTTYNGQALLSGQFTNKEFQVGAYSNQSIKASIGSTTSDKIGQVRIATGALITASGDISLTFKQVDGVNDVTLESVKVSSSAGTGIGVLAEVINKNSNRTGVKAYASVITTSDVAVQSGSLSNLTLNGIHLGNIADIKKNDSDGRLVAAINAVTSETGVEAYTDQKGRLNLRSIDGRGIEIKTDSVSNGPSALTMVNGGQDLTKGSTNYGRLSLTRLDAKSINVVSASDSQHLGFTAIGFGESQVAETTVNLRDVTGNFNANVKSASGANYNAVIASGNQSLGSGVTTLRGAMVVIDIAESAMKMLDKVRSDLGSVQNQMISTVNNISITQVNVKAAESQIRDVDFAEESANFNKNNILAQSGSYAMSQANTVQQNILRLLT

SEQ ID NO: 7 - protein, 475 aa, Legionella pneumophila
MAQVINTNVASLTAQRNLGVSGNMMQTSIQRLSSGLRINSAKDDAAGLAISQRMTAQIRGMNQAVRNANDGISLSQVAEGAMQETTNILQRMRELSVQAANSTNNSSDRASIQSEISQLKSELERIAQNTEFNGQRILDGSFSGASFQVGANSNQTINFSIGSIKASSIGGIATATGTEVAGAAATDITIAIGGGAATSINSSANFTGALNGQDATSAYAKAAAINDAGIGGLSVTASTSGTQAVGAIGGTAGDTYNLTINGVAIYTNLDVATALTNSDLRDAINGVSNQTGVVASLNGGNMTLTAADGRNITVTESGTGFTAGTDGLTVTGGAFDGRLRGTLSISAVDTIAIGGTVANIGLSANISKDTVGIDSLDVSTGSGRQTAIKRIDAALNSVNSNRANMGALQNRFESTIANLENVSDNLSAARSRIQDADYAAEMASLTKNQILQQAGTAMLAQANSLPQSVLSLLGR

SEQ ID NO: 8 - protein, 293 aa, Artificial Sequence
  B/Florida/4/2006 HA 1-1
TTTPTKSYFANLKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVK

SEQ ID NO: 9 - protein, 294 aa, Artificial Sequence
  B/Malaysia/2506/2004 HA 1-1
TTTPTKSHFANLKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 10 - protein, 272 aa, Artificial Sequence
  A/Solomon Islands/3/2006 HA1-1
SHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVR

SEQ ID NO: 11 - protein, 267 aa, Artificial Sequence
  A/Perth/16/2009 HA1-1
QSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVK

SEQ ID NO: 12 - protein, 267 aa, Artificial Sequence
  A/Wyoming/03/2003 HA1-1
QSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVK

SEQ ID NO: 13 - protein, 267 aa, Artificial Sequence
  A/New York/2782/2004
QSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALNVTMPNNEKFDKLYIWGVHHPSTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVK

SEQ ID NO: 14 - protein, 267 aa, Artificial Sequence
  A/Victoria/361/2011 HA1-1
QNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSDAPIGKCNSECITPNGSIPNDKPFQNVNRITYGACPRYVK

SEQ ID NO: 15 - protein, 267 aa, Artificial Sequence
  A/Aichi/2/68 HA1-1
QSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVK

SEQ ID NO: 16 - protein, 267 aa, Artificial Sequence
  A/Wisconsin/67/2005 HA1-1
QSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVK

SEQ ID NO: 17 - protein, 274 aa, Artificial Sequence
  A/Anhui/1/2005 HA1-1
EKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVK

SEQ ID NO: 18 - protein, 274 aa, Artificial Sequence
  A/Bar headed goose/Qinghai/1A/2005 HA1-1
EKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVK

SEQ ID NO: 19 - protein, 274 aa, Artificial Sequence
  A/Indonesia/5/2005 HA1-1
EKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVK

SEQ ID NO: 20 - protein, 274 aa, Artificial Sequence
  A/Vietnam/1203/2004 HA1-1
EKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 21 - protein, 274 aa, Artificial Sequence
  A/Hubei/1/2010 HA1-1
EKTHNGKLCDLNGVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVK

SEQ ID NO: 22 - protein, 274 aa, Artificial Sequence
  A/Hong Kong/156/97 HA1-1
ERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVK

SEQ ID NO: 23 - protein, 271 aa, Artificial Sequence
  A/Anhui/1/2013 HA1-1
ETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVK

SEQ ID NO: 24 - protein, 271 aa, Artificial Sequence
  A/Turkey/Italy/214845/2002 HA1-1
ETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSSVQVDANCEGDCYHSGGTIISNLPFQNINSRAVGKCPRYVK

SEQ ID NO: 25 - protein, 263 aa, Artificial Sequence
  A/New York/107/2003 HA1-1
ETVETTNIKKICTQGKRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSDAPLDSSCRGDCFHSGGTIVSSLPFQNINSRTVGKCPRYVK

SEQ ID NO: 26 - protein, 271 aa, Artificial Sequence
  A/mallard/Netherlands/12/2000 HA1-1
ETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQVDANCEGDCYHSGGTIISNLPFQNINSRAVGKCPRYVK

SEQ ID NO: 27 - protein, 271 aa, Artificial Sequence
  A/Canada/RV504/2004 HA1-1
ETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVK

SEQ ID NO: 28 - protein, 271 aa, Artificial Sequence
  A/Netherlands/219/03 HA1-1
ETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVK

SEQ ID NO: 29 - protein, 268 aa, Artificial Sequence
  A/Hong Kong/33982/2009 HA1-1
QTEHNGMLCATNLGHPLILDTCTIEGLIYGNPSCDLLLEGREWSYIVERPSAVNGTCYPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGLNSTLPFHNISKYAFGTCPKYVK

SEQ ID NO: 30 - protein, 268 aa, Artificial Sequence
  A/Hong Kong/1073/99 HA1-1
HTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVR

SEQ ID NO: 31 - protein, 268 aa, Artificial Sequence
  A/Chicken/Hong Kong/G9/97 HA1-1
HTEHNGMLCATNLGRPLILDTCTIEGLIYGNPSCDLLLGGREWSYIVERPSAVNGMCYPGNVENLEELRSFFSSASSYQRIQIFPDTIWNVSYSGTSKACSDSFYRSMRWLTQKNNAYPIQDAQYTNNRGKSILFMWGINHPPTDTAQTNLYTRTDTTTSVATEDINRTFKPVIGPRPLVNGLQGRIDYYWSVLKPGQTLRVRSNGNLIAPWYGHILSGESHGRILKTDLNSGSCVVQCQTERGGLNTTLPFHNVSKYAFGNCPKYVG

SEQ ID NO: 32 - protein, 268 aa, Artificial Sequence
  A/Chicken/Anhui/AH16/2008 HA1-1
HTEHNGMLCATNLGHPLILDTCTIEGLIYGNPSCDLLLGGGEWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINQPPTETAQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYVG

SEQ ID NO: 33 - protein, 268 aa, Artificial Sequence
  A/Swine/Hong Kong/9/98 HA1-1
HTEHNGMLCATNLGHPLILDTCTIEGLIYGNPSCDLLLGGREWSYIVERPSAVNGMCYPGNVENLEELRSLFSSASSYQRIQIFPDTIWNVSYSGTSKACSDSFYRSMRWLTQKNNAYPIQDAQYTNNRGKSILFMWGINHPPTDTVQTNLYTRTDTTTSVTTEDINRTFKPVIGPRPLVNGLHGRIDYYWSVLKPGQTLRVRSNGNLIAPWYGHILSGESHGRILKTDLNSGNCVVQCQTERGGLNTTLPFHNVSKYAFGNCPKYVG

SEQ ID NO: 34 - protein, 268 aa, Artificial Sequence
  A/Swine/Guangxi/58/2005 HA1-1
HTEHNGMLCATNLGRPLILDTCTIEGLIYGNPSCDLLLGGREWSYIVERSSAVNGMCYPGNVENLEELRSLFSSASSYQRIQIFPDTIWNVSYSGTSKACSDSFYRSMRWLTQKDNAYPIQDAQYTNNRGRSILFMWGINHPPTDTTQTNLYTRTDTTTSVATEDINRTFKPLIGPRPLVNGQQGRIDYYWSILKPGQTLRVRSNGNLIAPWYGHILSGESHGRILKTDLKKGNCVVQCQTERGGLNTTLPFHNVSKYAFGNCPKYIG

SEQ ID NO: 35 - protein, 293 aa, Artificial Sequence
  B/Shanghai/361/2002 HA1-1
TTTPIKSHFANLKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADCLHEKYGGLNKSKPYYTGEHAKAIGHCPIWVK

SEQ ID NO: 36 - protein, 293 aa, Artificial Sequence
  B/Wisconsin/1/2010 HA1-1
TTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVK

SEQ ID NO: 37 - protein, 293 aa, Artificial Sequence
  B/Sichuan/379/99 HA1-1
TTTPTKSHFANLKGTKTRGKLCPTCLNCTDLDVALGRPMCVGITPSAKASILHEIKPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADCLHEKYGGLNKSKPYYTGEHAKAIGNCPIWVK

SEQ ID NO: 38 - protein, 293 aa, Artificial Sequence
  B/Hubei-Wujiagang/158/2009 HA1-1
TTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVK

SEQ ID NO: 39 - protein, 293 aa, Artificial Sequence
  B/Texas/06/2011 HA1-1
TTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEEEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVK

SEQ ID NO: 40 - protein, 294 aa, Artificial Sequence
  B/Brisbane/60/2008 HA1-1
TTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 41 - protein, 294 aa, Artificial Sequence
  B/Bangladesh/5945/2009 HA1-1
TTTPTKSHFANLKGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 42 - protein, 294 aa, Artificial Sequence
  B/Ohio/1/2005 HA1-1
TTTPTKSHFANLKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 43 - protein, 294 aa, Artificial Sequence
  B/Hong Kong/259/2010 HA1-1
TTTPTKSHFANLKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 44 - protein, 294 aa, Artificial Sequence
  B/Hong Kong/330/2001 HA1-1
TTTPTKSHFANLKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVK

SEQ ID NO: 45 - protein, 239 aa, Artificial Sequence
  B/Florida/4/2006 HA1-2
GTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKG

SEQ ID NO: 46 - protein, 248 aa, Artificial Sequence
  B/Florida/4/2006 HA1-2 extension
GTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEAD

SEQ ID NO: 47 - protein, 241 aa, Artificial Sequence
  B/Brisbane/60/2008 HA1-2
KGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 48 - protein, 250 aa, Artificial Sequence
  B/Brisbane/60/2008  HA1-2 with extension
KGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEAD

SEQ ID NO: 49 - protein, 240 aa, Artificial Sequence
  B/Wisconsin/1/2010 HA1-2
KGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKG

SEQ ID NO: 50 - protein, 249 aa, Artificial Sequence
  B/Wisconsin/1/2010 HA1-2 with extension
KGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEAD

SEQ ID NO: 51 - protein, 241 aa, Artificial Sequence
  B/Bangladesh/5945/2009 HA1-2
KGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIKG

SEQ ID NO: 52 - protein, 250 aa, Artificial Sequence
  B/Bangladesh/5945/2009 HA1-2 extension
KGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIKGSLPLIGEAD

SEQ ID NO: 53 - protein, 241 aa, Artificial Sequence
  B/Hong Kong/259/2010 HA1-2
KGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 54 - protein, 250 aa, Artificial Sequence
  B/Hong Kong/259/2010 HA1-2 extension
KGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEAD

SEQ ID NO: 55 - protein, 240 aa, Artificial Sequence
  B/Sichuan/379/99 HA1-2
KGTKTRGKLCPTCLNCTDLDVALGRPMCVGITPSAKASILHEIKPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPDQTEDGGLPQSGRIVVDYMVQKPGKTGTIVYQRGILLPQKVWCASGRSKVIKG

SEQ ID NO: 56 - protein, 249 aa, Artificial Sequence
  B/Sichuan/379/99 HA1-2 extension
KGTKTRGKLCPTCLNCTDLDVALGRPMCVGITPSAKASILHEIKPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEAD

SEQ ID NO: 57 - protein, 240 aa, Artificial Sequence
  B/Hubei-Wujiagang/158/2009 HA1-2
KGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKG

SEQ ID NO: 58 - protein, 249 aa, Artificial Sequence
  B/Hubei-Wujiagang/158/2009 HA1-2 extension
KGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEAD

SEQ ID NO: 59 - protein, 240 aa, Artificial Sequence
  B/Texas/06/2011 HA1-2
KGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEEEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKG

SEQ ID NO: 60 - protein, 249 aa, Artificial Sequence
  B/Texas/06/2011 HA1-2 extension
KGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEEEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEAD

SEQ ID NO: 61 - protein, 241 aa, Artificial Sequence
  B/Malaysia/2506/2004 HA1-2
KGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 62 - protein, 250 aa, Artificial Sequence
  B/Malaysia/2506/2004 HA1-2 extension
KGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEAD

SEQ ID NO: 63 - protein, 223 aa, Artificial Sequence
  A/Solomon Islands/3/2006 HA1-2
KGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINS

SEQ ID NO: 64 - protein, 218 aa, Artificial Sequence
  A/Perth/16/2009 HA1-2
SPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSD

SEQ ID NO: 65 - protein, 218 aa, Artificial Sequence
  A/Wyoming/03/2003 HA1-2
SPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSD

SEQ ID NO: 66 - protein, 218 aa, Artificial Sequence
  A/New York/2782/2004 HA1-2
SPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALNVTMPNNEKFDKLYIWGVHHPSTDNDQISLYAQASGRITVSTKRSQQTVIPNIGSRPRVRDIPSRISIYWTIVKPGDILLINSTGNLIAPRGYFKIRSGKSSIMRSD

SEQ ID NO: 67 - protein, 218 aa, Artificial Sequence
  A/Victoria/361/2011 HA1-2
SPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSD

SEQ ID NO: 68 - protein, 218 aa, Artificial Sequence
  A/Aichi/2/68 HA1-2
NPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSD

SEQ ID NO: 69 - protein, 218 aa, Artificial Sequence
  A/Wisconsin/67/2005 HA1-2
SPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSD

SEQ ID NO: 70 - protein, 223 aa, Artificial Sequence
  A/Anhui/1/2005 HA1-2
GVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSE

SEQ ID NO: 71 - protein, 223 aa, Artificial Sequence
  A/Bar headed goose/Qinghai/1A/2005 HA1-2
GVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSE

SEQ ID NO: 72 - protein, 223 aa, Artificial Sequence
  A/Indonesia/5/2005 HA1-2
GVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSE

SEQ ID NO: 73 - protein, 223 aa, Artificial Sequence
  A/Hubei/1/2010/ HA1-2
GVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSE

SEQ ID NO: 74 - protein, 223 aa, Artificial Sequence
  A/Hong Kong/156/97 HA1-2
GVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSE

SEQ ID NO: 75 - protein, 216 aa, Artificial Sequence
  A/Anhui/1/2013 HA1-2
KRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSG

SEQ ID NO: 76 - protein, 216 aa, Artificial Sequence
  A/Turkey/Italy/214845/2002 HA1-2
KRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSS

SEQ ID NO: 77 - protein, 208 aa, Artificial Sequence
  A/New York/107/2003 HA1-2
KRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSD

SEQ ID NO: 78 - protein, 216 aa, Artificial Sequence
  A/Mallard/Netherlands/12/2000  HA1-2
KRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSG

SEQ ID NO: 79 - protein, 216 aa, Artificial Sequence
  A/Canada/RV504/2004 HA1-2
KRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSD

SEQ ID NO: 80 - protein, 223 aa, Artificial Sequence
  A/Vietnam/1203/2004 HA1-2
GVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSE

SEQ ID NO: 81 - protein, 216 aa, Artificial Sequence
  A/Netherlands/219/03 HA1-2
KRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSE

SEQ ID NO: 82 - protein, 216 aa, Artificial Sequence
  A/Hong Kong/33982/2009 HA1-2
GHPLILDTCTIEGLIYGNPSCDLLLEGREWSYIVERPSAVNGTCYPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTD

SEQ ID NO: 83 - protein, 216 aa, Artificial Sequence
  A/Hong Kong/1073/99 HA1-2
GHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTD

SEQ ID NO: 84 - protein, 216 aa, Artificial Sequence
  A/Chicken/Hong Kong/G9/97 HA1-2
GRPLILDTCTIEGLIYGNPSCDLLLGGREWSYIVERPSAVNGMCYPGNVENLEELRSFFSSASSYQRIQIFPDTIWNVSYSGTSKACSDSFYRSMRWLTQKNNAYPIQDAQYTNNRGKSILFMWGINHPPTDTAQTNLYTRTDTTTSVATEDINRTFKPVIGPRPLVNGLQGRIDYYWSVLKPGQTLRVRSNGNLIAPWYGHILSGESHGRILKTD

SEQ ID NO: 85 - protein, 216 aa, Artificial Sequence
  A/Chicken/Anhui/AH16/2008 HA1-2
GHPLILDTCTIEGLIYGNPSCDLLLGGGEWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINQPPTETAQTNLYTRTDTTTSVATEEINRTFKPLIGPRPLVNGLQGRIDYYWSVLKPGQTLRIRSNGNLIAPWYGHILSGESHGRILKTD

SEQ ID NO: 86 - protein, 216 aa, Artificial Sequence
  A/Swine/Hong Kong/9/98 HA1-2
GHPLILDTCTIEGLIYGNPSCDLLLGGREWSYIVERPSAVNGMCYPGNVENLEELRSLFSSASSYQRIQIFPDTIWNVSYSGTSKACSDSFYRSMRWLTQKNNAYPIQDAQYTNNRGKSILFMWGINHPPTDTVQTNLYTRTDTTTSVTTEDINRTFKPVIGPRPLVNGLHGRIDYYWSVLKPGQTLRVRSNGNLIAPWYGHILSGESHGRILKTD

SEQ ID NO: 87 - protein, 216 aa, Artificial Sequence
  A/Swine/Guangxi/58/2005 HA1-2
GRPLILDTCTIEGLIYGNPSCDLLLGGREWSYIVERSSAVNGMCYPGNVENLEELRSLFSSASSYQRIQIFPDTIWNVSYSGTSKACSDSFYRSMRWLTQKDNAYPIQDAQYTNNRGRSILFMWGINHPPTDTTQTNLYTRTDTTTSVATEDINRTFKPLIGPRPLVNGQQGRIDYYWSILKPGQTLRVRSNGNLIAPWYGHILSGESHGRILKTD

SEQ ID NO: 88 - protein, 240 aa, Artificial Sequence
  B/Shanghai/361/2002 HA1-2
KGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKG

SEQ ID NO: 89 - protein, 249 aa, Artificial Sequence
  B/Shanghai/361/2002 HA1-2 extension
KGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEAD

SEQ ID NO: 90 - protein, 241 aa, Artificial Sequence
  B/Ohio/1/2005 HA1-2
KGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 91 - protein, 250 aa, Artificial Sequence
  B/Ohio/1/2005 HA1-2 extension
KGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEAD

SEQ ID NO: 92 - protein, 241 aa, Artificial Sequence
  B/Hong Kong/330/2001 HA1-2
KGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKG

SEQ ID NO: 93 - protein, 250 aa, Artificial Sequence
  B/Hong Kong/330/2001 HA1-2 extension
KGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEAD

SEQ ID NO: 94 - protein, 248 aa, Artificial Sequence
  B/Florida/4/2006 HA1-2 modified C-terminus
GTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIEGDLPLDGEAD

SEQ ID NO: 95 - protein, 249 aa, Artificial Sequence
  B/Brisbane/60/2008 HA1-2 modified C-terminus
GTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIEGDLPLDGEAD

SEQ ID NO: 96 - protein, 250 aa, Artificial Sequence
  B/Hong Kong/259/2010 HA1-2 modified C-terminus
KGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIEGDLPLDGEAD

SEQ ID NO: 97 - protein, 249 aa, Artificial Sequence
  B/Bangladesh/5945/2009 HA1-2 modified C-terminus
GTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIEGDLPLDGEAD

SEQ ID NO: 98 - protein, 275 aa, Artificial Sequence
  A/Perth/16/2009 HA1-1L
ELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLK

SEQ ID NO: 99 - protein, 275 aa, Artificial Sequence
  A/Wyoming/03/2003 HA1-1L
ELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQNTLK

SEQ ID NO: 100 - protein, 275 aa, Artificial Sequence
  A/New York/2782/2004 HA1-1L
ELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALNVTMPNNEKFDKLYIWGVHHPSTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLK

SEQ ID NO: 101 - protein, 275 aa, Artificial Sequence
  A/Victoria/361/2011 HA1-1L
ELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSDAPIGKCNSECITPNGSIPNDKPFQNVNRITYGACPRYVKQSTLK

SEQ ID NO: 102 - protein, 275 aa, Artificial Sequence
  A/Aichi/2/68 HA1-1L
ELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLK

SEQ ID NO: 103 - protein, 275 aa, Artificial Sequence
  A/Wisconsin/67/2005 HA1-1L
ELVQSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLK

SEQ ID NO: 104 - protein, 288 aa, Artificial Sequence
  A/Anhui/1/2005 HA1-1L
HAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLAT

SEQ ID NO: 105 - protein, 288 aa, Artificial Sequence
  A/Bar headed goose/Qinghai/1A/2005 HA1-1L
HAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLAT

SEQ ID NO: 106 - protein, 288 aa, Artificial Sequence
  A/Indonesia/5/2005 HA1-1L
HAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLAT

SEQ ID NO: 107 - protein, 288 aa, Artificial Sequence
  A/Vietnam/1203/2004 HA1-1L
HAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLAT

SEQ ID NO: 108 - protein, 288 aa, Artificial Sequence
  A/Hubei/1/2010 HA1-1L
HAQDILEKTHNGKLCDLNGVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKSNKLVLAT

SEQ ID NO: 109 - protein, 288 aa, Artificial Sequence
  A/Hong Kong/156/97 HA1-1L
HAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLAT

SEQ ID NO: 110 - protein, 282 aa, Artificial Sequence
  A/Anhui/1/2013 HA1-1L
NATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLAT

SEQ ID NO: 111 - protein, 282 aa, Artificial Sequence
  A/Turkey/Italy/214845/2002 HA1-1L
NATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSSVQVDANCEGDCYHSGGTIISNLPFQNINSRAVGKCPRYVKQESLMLAT

SEQ ID NO: 112 - protein, 274 aa, Artificial Sequence
  A/New York/107/2003 HA1-1L
NATETVETTNIKKICTQGKRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSDAPLDSSCRGDCFHSGGTIVSSLPFQNINSRTVGKCPRYVKQKSLLLAT

SEQ ID NO: 113 - protein, 282 aa, Artificial Sequence
  A/Mallard/Netherlands/12/2000 HA1-1L
NATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQVDANCEGDCYHSGGTIISNLPFQNINSRAVGKCPRYVKQESLLLAT

SEQ ID NO: 114 - protein, 282 aa, Artificial Sequence
  A/Canada/RV504/2004 HA1-1L
NATETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLAT

SEQ ID NO: 115 - protein, 282 aa, Artificial Sequence
  A/Netherlands/219/03 HA1-1L
NATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLAT

SEQ ID NO: 116 - protein, 280 aa, Artificial Sequence
  A/Hong Kong/33982/2009 HA1-1L
AKELLQTEHNGMLCATNLGHPLILDTCTIEGLIYGNPSCDLLLEGREWSYIVERPSAVNGTCYPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGLNSTLPFHNISKYAFGTCPKYVKVNSLKLA

SEQ ID NO: 117 - protein, 280 aa, Artificial Sequence
  A/Hong Kong/1073/99 HA1-1L
AKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLA

SEQ ID NO: 118 - protein, 280 aa, Artificial Sequence
  A/Chicken/Hong Kong/G9/97 HA1-1L
AKELLHTEHNGMLCATNLGRPLILDTCTIEGLIYGNPSCDLLLGGREWSYIVERPSAVNGMCYPGNVENLEELRSFFSSASSYQRIQIFPDTIWNVSYSGTSKACSDSFYRSMRWLTQKNNAYPIQDAQYTNNRGKSILFMWGINHPPTDTAQTNLYTRTDTTTSVATEDINRTFKPVIGPRPLVNGLQGRIDYYWSVLKPGQTLRVRSNGNLIAPWYGHILSGESHGRILKTDLNSGSCVVQCQTERGGLNTTLPFHNVSKYAFGNCPKYVGVKSLKLA

SEQ ID NO: 119 - protein, 280 aa, Artificial Sequence
  A/Chicken/Anhui/AH16/2008 HA1-1L
AKELLHTEHNGMLCATNLGHPLILDTCTIEGLIYGNPSCDLLLGGGEWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINQPPTETAQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYVGIKSLKLA

SEQ ID NO: 120 - protein, 280 aa, Artificial Sequence
  A/Swine/Hong Kong/9/98 HA1-1L
AKELLHTEHNGMLCATNLGHPLILDTCTIEGLIYGNPSCDLLLGGREWSYIVERPSAVNGMCYPGNVENLEELRSLFSSASSYQRIQIFPDTIWNVSYSGTSKACSDSFYRSMRWLTQKNNAYPIQDAQYTNNRGKSILFMWGINHPPTDTVQTNLYTRTDTTTSVTTEDINRTFKPVIGPRPLVNGLHGRIDYYWSVLKPGQTLRVRSNGNLIAPWYGHILSGESHGRILKTDLNSGNCVVQCQTERGGLNTTLPFHNVSKYAFGNCPKYVGVKSLKLA

SEQ ID NO: 121 - protein, 280 aa, Artificial Sequence
  A/Swine/Guangxi/58/2005 HA1-1L
AKELLHTEHNGMLCATNLGRPLILDTCTIEGLIYGNPSCDLLLGGREWSYIVERSSAVNGMCYPGNVENLEELRSLFSSASSYQRIQIFPDTIWNVSYSGTSKACSDSFYRSMRWLTQKDNAYPIQDAQYTNNRGRSILFMWGINHPPTDTTQTNLYTRTDTTTSVATEDINRTFKPLIGPRPLVNGQQGRIDYYWSILKPGQTLRVRSNGNLIAPWYGHILSGESHGRILKTDLKKGNCVVQCQTERGGLNTTLPFHNVSKYAFGNCPKYIGVKSLKLA

SEQ ID NO: 122 - protein, 644 aa, Artificial Sequence
  HL098 R3.HA1-2 FL4
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 123 - protein, 9 aa, Artificial Sequence
  B/FL/4/2006 HA peptide
SLPLIGEAD

SEQ ID NO: 124 - protein, 584 aa, Artificial Sequence
  Influenza B/Florida/4/2006 HA
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 125 - protein, 652 aa, Artificial Sequence
  HL352 STF2.R3.HA 1-2 FL4
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 126 - protein, 752 aa, Artificial Sequence
  HL772 STF2.D3Ins.HA 1-2 WI1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 127 - protein, 503 aa, Artificial Sequence
  Flagellin used for fusion proteins with D3I-o1 insert
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 128 - protein, 753 aa, Artificial Sequence
  STF2.D3Ins.HA1-2 BR60 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 129 - protein, 778 aa, Artificial Sequence
  STF2.D3Ins.HA1-1L PE16 D3I-o1 with mutation
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGEICDSPHQILDGKNCTLIDALLGDPQCDGFQNKKWDLYVERSSAYSNCYPYDVPDYASLRSLVASSGTLEFNNESFNWTGVTQNGTSSACIRRSKNSFFSRLNWLTHLNFKYPALNVTMPNNEQFDKLYVWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQDTLETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 130 - protein, 785 aa, Artificial Sequence
  STF2.D3Ins.HA1-1L AH1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPANATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 131 - protein, 4 aa, Artificial Sequence
  Peptide from flagellin (FljB)
VTLA

SEQ ID NO: 132 - protein, 5 aa, Artificial Sequence
  Peptide from flagellin (FljB)
EVNVA

SEQ ID NO: 133 - protein, 8 aa, Artificial Sequence
  Peptide from flagellin (FljB)
KYFVTIGG

SEQ ID NO: 134 - protein, 6 aa, Artificial Sequence
  Peptide from flagellin (FliC)
VLTANI

SEQ ID NO: 135 - protein, 9 aa, Artificial Sequence
  Peptide from flagellin (FliC)
ELAKLAIKL

SEQ ID NO: 136 - protein, 4 aa, Artificial Sequence
  Peptide from flagellin (FliC)
IEYK

SEQ ID NO: 137 - protein, 5 aa, Artificial Sequence
  Peptide from flagellin (FliC)
TVSLA

SEQ ID NO: 138 - protein, 7 aa, Artificial Sequence
  Peptide from flagellin (FliC)
LGITASI

SEQ ID NO: 139 - protein, 9 aa, Artificial Sequence
  Peptide from flagellin (FliC)
SLNFDVTVG

SEQ ID NO: 140 - protein, 4 aa, Artificial Sequence
  Peptide from flagellin (FliC)
TVFT

SEQ ID NO: 141 - protein, 628 aa, Artificial Sequence
  HL092 STF2.R3-HA 1-2 PR8
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 142 - protein, 628 aa, Artificial Sequence
  HL064 STF2.R3.HA1-2 SI3
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 143 - protein, 628 aa, Artificial Sequence
  HL185 STF2.R3.HA1-2 CA07
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 144 - protein, 628 aa, Artificial Sequence
  HL149 STF2.R3.HA1-2 IN5
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSEGVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 145 - protein, 508 aa, Artificial Sequence
  HL199 STF2.R23.HA1-2 FL4
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 146 - protein, 745 aa, Artificial Sequence
  HL077 STF2.HA1-2 FL4
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKG

SEQ ID NO: 147 - protein, 1292 aa, Artificial Sequence
  HL169 STF2.R3.HA1-2 B/BR60
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLRMAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 148 - protein, 654 aa, Artificial Sequence
  HL483 STF2.R3.HA1-2 BR60
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 149 - protein, 652 aa, Artificial Sequence
  HL610 STF2.R3.HA1-2 FL4
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIEGDLPLDGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 150 - protein, 654 aa, Artificial Sequence
  HL611 STF2.R3.HA1-2 BR60
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAEGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIEGDLPLDGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 151 - protein, 752 aa, Artificial Sequence
  HL656 STF2.D3Ins.HA1-2 FL4 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 152 - protein, 652 aa, Artificial Sequence
  HL724 STF2.R3.HA1-2 WI1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIEGDLPLDGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 153 - protein, 11 aa, Artificial Sequence
  Peptide for HA1-2 modified C-terminus
EGDLPLDGEAD

SEQ ID NO: 154 - protein, 652 aa, Artificial Sequence
  HL719 STF2.R3.HA1-2 WI1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 155 - protein, 654 aa, Artificial Sequence
  HL753 STF2.R3.HA1-2 HK259
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIEGDLPLDGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 156 - protein, 653 aa, Artificial Sequence
  HL742 STF2.R3.HA1-2 BD5495
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIEGDLPLDGEADVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 157 - protein, 753 aa, Artificial Sequence
  HL774 STF2.D3Ins.HA1-2 HK259 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTETRGKLCPKCPNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 158 - protein, 753 aa, Artificial Sequence
  HL787 STF2.D3Ins.HA1-2 BD5495 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 159 - protein, 755 aa, Artificial Sequence
  HL849 STF2.D3Ins.HA1-2 WI1 D3I-i1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 160 - protein, 755 aa, Artificial Sequence
  HL848 STF2.D3Ins.HA1-2 WI1 D3I-s1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 161 - protein, 755 aa, Artificial Sequence
  HL825 STF2.D2Ins.HA1-2 WI1 D2I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 162 - protein, 755 aa, Artificial Sequence
  HL826 STF2.D2Ins.HA1-2 WI1 D2I-o2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 163 - protein, 755 aa, Artificial Sequence
  HL827 STF2.D2Ins.HA1-2 WI1 D2I-o3
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 164 - protein, 755 aa, Artificial Sequence
  HL828 STF2.D1Ins.HA1-2 WI1 D1I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 165 - protein, 755 aa, Artificial Sequence
  HL850 STF2.D2Ins.HA1-2 WI1 D2I-i1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 166 - protein, 756 aa, Artificial Sequence
  HL733 STF2.D2Ins.HA1-2 BR60 D2I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVGKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADGKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 167 - protein, 756 aa, Artificial Sequence
  HL856 STF2.D2Ins.HA1-2 BR60 D2I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 168 - protein, 756 aa, Artificial Sequence
  HL857 STF2.D2Ins.HA1-2 BR60 D2I-o2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 169 - protein, 755 aa, Artificial Sequence
  HL888 STF2.D3Ins.HA1-2 WI1 D3I-o2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDAKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADDNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 170 - protein, 755 aa, Artificial Sequence
  HL890 STF2.D3Ins.HA1-2 WI1 D2I-c1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 171 - protein, 755 aa, Artificial Sequence
  HL892 STF2.D2Ins.HA1-2 WI1 D2I-i2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 172 - protein, 756 aa, Artificial Sequence
  HL858 STF2.D3Ins.HA1-2 BR60 D2I-o3
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 173 - protein, 756 aa, Artificial Sequence
  HL860 STF2.D3Ins.HA1-2 BR60 D3I-s1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 174 - protein, 756 aa, Artificial Sequence
  HL889 STF2.D3Ins.HA1-2 BR60 D3I-o2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADDNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 175 - protein, 756 aa, Artificial Sequence
  HL891 STF2.D2Ins.HA1-2 BR60 D2I-c1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 176 - protein, 756 aa, Artificial Sequence
  HL893 STF2.D2Ins.HA1-2 BR60 D2I-i2
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 177 - protein, 752 aa, Artificial Sequence
  HL864 STF2.D3Ins.HA1-2 WI1 mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTKFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNVAITVLGNTVNNLSEARSRIEDSDYATEVSNMSRAQILQQAGTSVLAQANQVPQNVLSLLR

SEQ ID NO: 178 - protein, 503 aa, Artificial Sequence
  Flagellin (FljB) with mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTKFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNVAITVLGNTVNNLSEARSRIEDSDYATEVSNMSRAQILQQAGTSVLAQANQVPQNVLSLLR

SEQ ID NO: 179 - protein, 654 aa, Artificial Sequence
  HL854 STF2.D2Ins.HA1-2 B/WI1, no D3
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVGKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADGKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 180 - protein, 756 aa, Artificial Sequence
  HL 861 STF2.D3Ins.HA1-2 BR60 D3I-i1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 181 - protein, 756 aa, Artificial Sequence
  HL862 STF2.D2Ins.HA1-2 BR60 D2I-i1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 182 - protein, 752 aa, Artificial Sequence
  HL863 STF2.D3Ins.HA1-2 SI379 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTKTRGKLCPTCLNCTDLDVALGRPMCVGITPSAKASILHEIKPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 183 - protein, 755 aa, Artificial Sequence
  HL903 STF2.D3Ins.HA1-2 SI379 D3I-i1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATKGTKTRGKLCPTCLNCTDLDVALGRPMCVGITPSAKASILHEIKPVTSGCFPIMHDRTKIRQLPNLLRGYEKIRLSTQNVINAEKAPGGPYRLGTSGSCPNATSKSGFFATMAWAVPRDNNKTATNPLTVEVPHICTKEEDQITVWGFHSDDKTQMKNLYGDSNPQKFTSSANGITTHYVSQIGGFPDQTEDGGLPQSGRIVVDYMVQKPGKTGTIVYQRGILLPQKVWCASGRSKVIKGSLPLIGEADDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 184 - protein, 752 aa, Artificial Sequence
  HL869 STF2.D3Ins.HA1-2 HU158 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 185 - protein, 752 aa, Artificial Sequence
  HL871 STF2.D3Ins.HA1-2 TX6 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEEEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 186 - protein, 778 aa, Artificial Sequence
  HL639 STF2.D3Ins.HA1-L DE16 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 187 - protein, 680 aa, Artificial Sequence
  HL836 STF2.D3Ins.HA1-L VT361 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAELVQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSDAPIGKCNSECITPNGSIPNDKPFQNVNRITYGACPRYVKQSTLKAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 188 - protein, 791 aa, Artificial Sequence
  HL982 STF2.D3Ins.HA1-L AH1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 189 - protein, 791 aa, Artificial Sequence
  HL960 STF2.D3Ins.HA1-L IND5 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 190 - protein, 777 aa, Artificial Sequence
  HL876 STF2.D3Ins.HA1-1L NY107 D31-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPANATETVETTNIKKICTQGKRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSDAPLDSSCRGDCFHSGGTIVSSLPFQNINSRTVGKCPRYVKQKSLLLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 191 - protein, 785 aa, Artificial Sequence
  HL926 STF2.D3Ins.HA1-1L CA504 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPANATETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 192 - protein, 785 aa, Artificial Sequence
  HL880 STF2.D3Ins.HA1-1L NL219 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPANATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 193 - protein, 753 aa, Artificial Sequence; identical to SEQ ID NO: 157
  HL958 STF2.D3Ins.HA1-2 B/HK/259 extension

SEQ ID NO: 194 - protein, 721 aa, Artificial Sequence
  STF2.D3Ins.HA1-2 PE16 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPASPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 195 - protein, 770 aa, Artificial Sequence
  STF2.D3Ins.HA1-1 PE16 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 196 - protein, 721 aa, Artificial Sequence
  STF2.D3Ins.HA1-2 WY03 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPASPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 197 - protein, 770 aa, Artificial Sequence
  STF2.D3Ins.HA1-1 WY03 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 198 - protein, 778 aa, Artificial Sequence
  STF2.D3Ins.HA1-1L WY03 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQNTLKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 199 - protein, 721 aa, Artificial Sequence
  STF2.D3Ins.HA1-2 NY2782 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPASPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALNVTMPNNEKFDKLYIWGVHHPSTDNDQISLYAQASGRITVSTKRSQQTVIPNIGSRPRVRDIPSRISIYWTIVKPGDILLINSTGNLIAPRGYFKIRSGKSSIMRSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 200 - protein, 770 aa, Artificial Sequence
  STF2.D3Ins.HA1-1 NY2782 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALNVTMPNNEKFDKLYIWGVHHPSTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 201 - protein, 778 aa, Artificial Sequence
  STF2.D3Ins.HA1-1L NY2782 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALNVTMPNNEKFDKLYIWGVHHPSTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 202 - protein, 721 aa, Artificial Sequence
  STF2.D3Ins.HA1-2 VT361 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPASPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 203 - protein, 770 aa, Artificial Sequence
  STF2.D3Ins.HA1-1 VT361 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAQNSSIGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTQLNFKYPALNVTMPNNEQFDKLYIWGVHHPVTDKDQIFLYAQSSGRITVSTKRSQQAVIPNIGYRPRIRNIPSRISIYWTIVKPGDILLINSTGNLIAPRGYFKIRSGKSSIMRSDAPIGKCNSECITPNGSIPNDKPFQNVNRITYGACPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 204 - protein, 721 aa, Artificial Sequence
  STF2.D3Ins.HA1-2 Aichi2 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPANPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 205 - protein, 770 aa, Artificial Sequence
  STF2.D3Ins.HA1-1 Aichi2 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 206 - protein, 778 aa, Artificial Sequence
  STF2.D3Ins.HA1-1L Aichi2 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 207 - protein, 721 aa, Artificial Sequence
  STF2.D3Ins.HA1-2 WI67 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPASPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 208 - protein, 770 aa, Artificial Sequence
  STF2.D3Ins.HA1-1 WI67 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAQSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 209 - protein, 778 aa, Artificial Sequence
  STF2.D3Ins.HA1-1L WI67 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGGICDSPHQILDGENCTLIDALLGDPQCDGFQNKKWDLFVERSKAYSNCYPYDVPDYASLRSLVASSGTLEFNDESFNWTGVTQNGTSSACKRRSNNSFFSRLNWLTHLKFKYPALNVTMPNNEKFDKLYIWGVHHPGTDNDQIFLHAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 210 - protein, 726 aa, Artificial Sequence
  STF2.D3Ins.HA1-2 AH1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 211 - protein, 777 aa, Artificial Sequence
  STF2.D3Ins.HA1-1 AH1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 212 - protein, 726 aa, Artificial Sequence
  STF2.D3Ins.HA1-2 QH1A D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 213 - protein, 777 aa, Artificial Sequence
  STF2.D3Ins.HA1-1 QH1A D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 214 - protein, 791 aa, Artificial Sequence
  STF2.D3Ins.HA1-1L QH1A D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 215 - protein, 726 aa, Artificial Sequence
  STF2.D3Ins.HA1-2 IND5 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 216 - protein, 777 aa, Artificial Sequence
  STF2.D3Ins.HA1-1 IND5 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 217 - protein, 726 aa, Artificial Sequence
  STF2.D3Ins.HA1-2 VN1203 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 218 - protein, 777 aa, Artificial Sequence
  STF2.D3Ins.HA1-1 VN1203 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 219 - protein, 791 aa, Artificial Sequence
  STF2.D3Ins.HA1-1L VN1203 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 220 - protein, 726 aa, Artificial Sequence
  STF2.D3Ins.HA1-2 HB1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 221 - protein, 777 aa, Artificial Sequence
  STF2.D3Ins.HA1-1 HB1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAEKTHNGKLCDLNGVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 222 - protein, 791 aa, Artificial Sequence
  STF2.D3Ins.HA1-1L HB1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHAQDILEKTHNGKLCDLNGVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKSNKLVLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 223 - protein, 726 aa, Artificial Sequence
  STF2.D3Ins.HA1-2 HK156 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 224 - protein, 777 aa, Artificial Sequence
  STF2.D3Ins.HA1-1 HK156 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 225 - protein, 791 aa, Artificial Sequence
  STF2.D3Ins.HA1-1L HK156 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 226 - protein, 719 aa, Artificial Sequence
  STF2.D3Ins.HA1-2 AH1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 227 - protein, 774 aa, Artificial Sequence
  STF2.D3Ins.HA1-1 AH1 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 228 - protein, 275 aa, Artificial Sequence
  A/Perth/16/2009 HA1-1L modified
ELVQSSSTGEICDSPHQILDGKNCTLIDALLGDPQCDGFQNKKWDLYVERSSAYSNCYPYDVPDYASLRSLVASSGTLEFNNESFNWTGVTQNGTSSACIRRSKNSFFSRLNWLTHLNFKYPALNVTMPNNEQFDKLYVWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQDTLE

SEQ ID NO: 229 - protein, 719 aa, Artificial Sequence
  STF2.D3Ins.HA1-2 IT214845 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSSTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 230 - protein, 774 aa, Artificial Sequence
  STF2.D3Ins.HA1-1 IT214845 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSSVQVDANCEGDCYHSGGTIISNLPFQNINSRAVGKCPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 231 - protein, 785 aa, Artificial Sequence
  STF2.D3Ins.HA1-1L IT214845 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPANATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSSVQVDANCEGDCYHSGGTIISNLPFQNINSRAVGKCPRYVKQESLMLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 232 - protein, 711 aa, Artificial Sequence
  STF2.D3Ins.HA1-2 NY107 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 233 - protein, 766 aa, Artificial Sequence
  STF2.D3Ins.HA1-1 NY107 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAETVETTNIKKICTQGKRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSDAPLDSSCRGDCFHSGGTIVSSLPFQNINSRTVGKCPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 234 - protein, 719 aa, Artificial Sequence
  STF2.D3Ins.HA1-2 NL12 D3I-O1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 235 - protein, 774 aa, Artificial Sequence
  STF2.D3Ins.HA1-1 NL12 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQVDANCEGDCYHSGGTIISNLPFQNINSRAVGKCPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 236 - protein, 785 aa, Artificial Sequence
  STF2.D3Ins.HA1-1L NL12 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPANATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQVDANCEGDCYHSGGTIISNLPFQNINSRAVGKCPRYVKQESLLLATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 237 - protein, 719 aa, Artificial Sequence
  STF2.D3Ins.HA1-2 CA504 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 238 - protein, 774 aa, Artificial Sequence
  STF2.D3Ins.HA1-1 CA504 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 239 - protein, 719 aa, Artificial Sequence
  STF2.D3Ins.HA1-2 NL219 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 240 - protein, 774 aa, Artificial Sequence
  STF2.D3Ins.HA1-1 NL219 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 241 - protein, 719 aa, Artificial Sequence
  STF2.D3Ins.HA1-2 HK33982 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGHPLILDTCTIEGLIYGNPSCDLLLEGREWSYIVERPSAVNGTCYPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 242 - protein, 771 aa, Artificial Sequence
  STF2.D3Ins.HA1-1 HK33982 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAQTEHNGMLCATNLGHPLILDTCTIEGLIYGNPSCDLLLEGREWSYIVERPSAVNGTCYPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGLNSTLPFHNISKYAFGTCPKYVKTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 243 - protein, 783 aa, Artificial Sequence
  STF2.D3Ins.HA1-1L HK33982 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAAKELLQTEHNGMLCATNLGHPLILDTCTIEGLIYGNPSCDLLLEGREWSYIVERPSAVNGTCYPGNVENLEELRTLFSSASSYQRIQIFPDTTWNVTYTGTSRSCSGSFYRSMRWLTQKSGFYPVQDAKYTNNRGKNILFVWGIHHPHTYTDQTTLYIRNDTTTSVTTEELNRIFKPVIVPRLLVNGQQGRIDYYWSVLKPGQTLRVRSNGNLIAPWYGHVLSGGSHGRILKTDLKSGNCVVQCQTEKGGLNSTLPFHNISKYAFGTCPKYVKVNSLKLATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 244 - protein, 719 aa, Artificial Sequence
  STF2.D3Ins.HA1-2 HK1073 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 245 - protein, 771 aa, Artificial Sequence
  STF2.D3Ins.HA1-1 HK1073 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 246 - protein, 783 aa, Artificial Sequence
  STF2.D3Ins.HA1-1L HK1073 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 247 - protein, 719 aa, Artificial Sequence
  STF2.D3Ins.HA1-2 HKG9 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGRPLILDTCTIEGLIYGNPSCDLLLGGREWSYIVERPSAVNGMCYPGNVENLEELRSFFSSASSYQRIQIFPDTIWNVSYSGTSKACSDSFYRSMRWLTQKNNAYPIQDAQYTNNRGKSILFMWGINHPPTDTAQTNLYTRTDTTTSVATEDINRTFKPVIGPRPLVNGLQGRIDYYWSVLKPGQTLRVRSNGNLIAPWYGHILSGESHGRILKTDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 248 - protein, 771 aa, Artificial Sequence
  STF2.D3Ins.HA1-1 HKG9 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHTEHNGMLCATNLGRPLILDTCTIEGLIYGNPSCDLLLGGREWSYIVERPSAVNGMCYPGNVENLEELRSFFSSASSYQRIQIFPDTIWNVSYSGTSKACSDSFYRSMRWLTQKNNAYPIQDAQYTNNRGKSILFMWGINHPPTDTAQTNLYTRTDTTTSVATEDINRTFKPVIGPRPLVNGLQGRIDYYWSVLKPGQTLRVRSNGNLIAPWYGHILSGESHGRILKTDLNSGSCVVQCQTERGGLNTTLPFHNVSKYAFGNCPKYVGTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 249 - protein, 783 aa, Artificial Sequence
  STF2.D3Ins.HA1-1L HKG9 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAAKELLHTEHNGMLCATNLGRPLILDTCTIEGLIYGNPSCDLLLGGREWSYIVERPSAVNGMCYPGNVENLEELRSFFSSASSYQRIQIFPDTIWNVSYSGTSKACSDSFYRSMRWLTQKNNAYPIQDAQYTNNRGKSILFMWGINHPPTDTAQTNLYTRTDTTTSVATEDINRTFKPVIGPRPLVNGLQGRIDYYWSVLKPGQTLRVRSNGNLIAPWYGHILSGESHGRILKTDLNSGSCVVQCQTERGGLNTTLPFHNVSKYAFGNCPKYVGVKSLKLATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 250 - protein, 719 aa, Artificial Sequence
  STF2.D3Ins.HA1-2 AH16 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGHPLILDTCTIEGLIYGNPSCDLLLGGGEWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINQPPTETAQTNLYTRTDTTTSVATEEINRTFKPLIGPRPLVNGLQGRIDYYWSVLKPGQTLRIRSNGNLIAPWYGHILSGESHGRILKTDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 251 - protein, 771 aa, Artificial Sequence
  STF2.D3Ins.HA1-1 AH16 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHTEHNGMLCATNLGHPLILDTCTIEGLIYGNPSCDLLLGGGEWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINQPPTETAQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYVGTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 252 - protein, 783 aa, Artificial Sequence
  STF2.D3Ins.HA1-1L AH16 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAAKELLHTEHNGMLCATNLGHPLILDTCTIEGLIYGNPSCDLLLGGGEWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINQPPTETAQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYVGIKSLKLATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 253 - protein, 719 aa, Artificial Sequence
  STF2.D3Ins.HA1-2 HK9 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGHPLILDTCTIEGLIYGNPSCDLLLGGREWSYIVERPSAVNGMCYPGNVENLEELRSLFSSASSYQRIQIFPDTIWNVSYSGTSKACSDSFYRSMRWLTQKNNAYPIQDAQYTNNRGKSILFMWGINHPPTDTVQTNLYTRTDTTTSVTTEDINRTFKPVIGPRPLVNGLHGRIDYYWSVLKPGQTLRVRSNGNLIAPWYGHILSGESHGRILKTDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 254 - protein, 771 aa, Artificial Sequence
  STF2.D3Ins.HA1-1 HK9 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHTEHNGMLCATNLGHPLILDTCTIEGLIYGNPSCDLLLGGREWSYIVERPSAVNGMCYPGNVENLEELRSLFSSASSYQRIQIFPDTIWNVSYSGTSKACSDSFYRSMRWLTQKNNAYPIQDAQYTNNRGKSILFMWGINHPPTDTVQTNLYTRTDTTTSVTTEDINRTFKPVIGPRPLVNGLHGRIDYYWSVLKPGQTLRVRSNGNLIAPWYGHILSGESHGRILKTDLNSGNCVVQCQTERGGLNTTLPFHNVSKYAFGNCPKYVGTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 255 - protein, 783 aa, Artificial Sequence
  STF2.D3Ins.HA1-1L HK9 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAAKELLHTEHNGMLCATNLGHPLILDTCTIEGLIYGNPSCDLLLGGREWSYIVERPSAVNGMCYPGNVENLEELRSLFSSASSYQRIQIFPDTIWNVSYSGTSKACSDSFYRSMRWLTQKNNAYPIQDAQYTNNRGKSILFMWGINHPPTDTVQTNLYTRTDTTTSVTTEDINRTFKPVIGPRPLVNGLHGRIDYYWSVLKPGQTLRVRSNGNLIAPWYGHILSGESHGRILKTDLNSGNCVVQCQTERGGLNTTLPFHNVSKYAFGNCPKYVGVKSLKLATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 256 - protein, 719 aa, Artificial Sequence
  STF2.D3Ins.HA1-2 GX58 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAGRPLILDTCTIEGLIYGNPSCDLLLGGREWSYIVERSSAVNGMCYPGNVENLEELRSLFSSASSYQRIQIFPDTIWNVSYSGTSKACSDSFYRSMRWLTQKDNAYPIQDAQYTNNRGRSILFMWGINHPPTDTTQTNLYTRTDTTTSVATEDINRTFKPLIGPRPLVNGQQGRIDYYWSILKPGQTLRVRSNGNLIAPWYGHILSGESHGRILKTDTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 257 - protein, 771 aa, Artificial Sequence
  STF2.D3Ins.HA1-1 GX58 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAHTEHNGMLCATNLGRPLILDTCTIEGLIYGNPSCDLLLGGREWSYIVERSSAVNGMCYPGNVENLEELRSLFSSASSYQRIQIFPDTIWNVSYSGTSKACSDSFYRSMRWLTQKDNAYPIQDAQYTNNRGRSILFMWGINHPPTDTTQTNLYTRTDTTTSVATEDINRTFKPLIGPRPLVNGQQGRIDYYWSILKPGQTLRVRSNGNLIAPWYGHILSGESHGRILKTDLKKGNCVVQCQTERGGLNTTLPFHNVSKYAFGNCPKYIGTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 258 - protein, 783 aa, Artificial Sequence
  STF2.D3Ins.HA1-1L GX58 D3I-o1
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAAKELLHTEHNGMLCATNLGRPLILDTCTIEGLIYGNPSCDLLLGGREWSYIVERSSAVNGMCYPGNVENLEELRSLFSSASSYQRIQIFPDTIWNVSYSGTSKACSDSFYRSMRWLTQKDNAYPIQDAQYTNNRGRSILFMWGINHPPTDTTQTNLYTRTDTTTSVATEDINRTFKPLIGPRPLVNGQQGRIDYYWSILKPGQTLRVRSNGNLIAPWYGHILSGESHGRILKTDLKKGNCVVQCQTERGGLNTTLPFHNVSKYAFGNCPKYIGVKSLKLATKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 259 - protein, 752 aa, Artificial Sequence
  STF2.D3Ins.HA1-2 D3I-o1 with extension
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTRTRGKLCPDCLNCTDLDVALGRPMCVGTTPSAKASILHEVRPVTSGCFPIMHDRTKIRQLPNLLRGYENIRLSTQNVIDAEKALGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGGFPDQTEDGGLPQSGRIVVDYMVQKPGKTGTIVYQRGVLLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 260 - protein, 753 aa, Artificial Sequence
  STF2.D3Ins.HA1-2 D3I-o1 with extension
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTETRGKLCPKCLNCTDLDVALGRPKCTGNIPSARVSILHEVRPVTSGCFPIMHDRTKIRQLPNLLRGYEHIRLSTHNVINAENAPGGSYKIGTSGSCPNVTNGNGFFATMAWAVPKNDNNKTATNSLTIEVPYICTEGEDQITVWGFHSDNEAQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 261 - protein, 753 aa, Artificial Sequence
  STF2.D3Ins.HA1-2 D3I-o1 with extension
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTKTRGKLCPKCLNCTDLDVALGRPKCTGNIPSAEVSILHEVRPVTSGCFPIMHDRTKIRQLPNLLRGYEHIRLSTHNVINAEKAPGGPYKIGTSGSCPNVTNGNGFFATMAWAVPKNDNNKTATNSLTIEVPYICTEGEDQITIWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 262 - protein, 753 aa, Artificial Sequence
  STF2.D3Ins.HA1-2 D3I-o1 with extension
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAKGTKTRGKLCPKCLNCTDLDVALGRPKCTGNIPSAKVSILHEVRPVTSGCFPIMHDRTKIRQLPNLLRGYERIRLSNHNVINAEKAPGGPYKIGTSGSCPNVTNGNGFFATMAWAVPKNENNKTATNSLTIEVPYICTEGEDQITVWGFHSDSETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 263 - protein, 584 aa, Artificial Sequence
  Influenza B/Wisonsin/1/2010 HA
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 264 - protein, 585 aa, Artificial Sequence
  Influenza B/Brisbane/60/2008 HA
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 265 - protein, 585 aa, Artificial Sequence
  Influenza B/Bangladesh/5495/2009 HA
MKAIIVLLMVVTSNADRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTNNVINAENAPGGPYKIGTSGSCPNVTNGNGFFATMAWAVPKNDKNKTATNPLTIEVPYICTEGEDQITVWGFHSDNEIQMAKLYGDSRPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 266 - protein, 584 aa, Artificial Sequence
  Influenza B/Hubei-Wujiagang/158/2009 HA
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICTEGEDQITVWGFHSDNKNQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 267 - protein, 584 aa, Artificial Sequence
  Influenza B/Texas/6/2011 HA
MKAIIVLLMVVTSNADRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEEEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 268 - protein, 852 aa, Artificial Sequence
  HL186 STF2.R3.2x.HA1-2 CA07
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLASGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIIS

SEQ ID NO: 269 - protein, 680 aa, Artificial Sequence
  HL490 STF2.R3.HA1-1L PE16
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAELVQSSSTGEICDSPHQILDGKNCTLIDALLGDPQCDGFQNKKWDLYVERSSAYSNCYPYDVPDYASLRSLVASSGTLEFNNESFNWTGVTQNGTSSACIRRSKNSFFSRLNWLTHLNFKYPALNVTMPNNEQFDKLYVWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQDTLEAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 270 - protein, 506 aa, Artificial Sequence
  Flagellin (FljB) with GG mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVGGKAYANNGTTLDVSGLDDAAIKAATGGTNGTASVTGGAVKFDADNNKYFVTIGGFTGADAAKNGDYEVNVATDGTVTLAAGATKTTMPAGATTKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 271 - protein, 404 aa, Artificial Sequence
  Flagellin (FljB) D3 removed
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVGKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 272 - protein, 404 aa, Artificial Sequence
  Flagellin (FljB) D3 removed with R to A mutation
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVGKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 273 - protein, 275 aa, Artificial Sequence
  A/Wyoming/03/2003 HA1-1L modified
ELVQSSSTGGICDSPHQILDGENCTLIDALLGDPQCDGFQNKKWDLYVERSSAYSNCYPYDVPDYASLRSLVASSGTLEFNNESFNWAGVTQNGTSSACKRRSNKSFFSRLNWLTHLKYKYPALNVTMPNNEKFDKLYVWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQDTLE

SEQ ID NO: 274 - protein, 275 aa, Artificial Sequence
  A/New York/2782/2004 HA1-1L modified
ELVQSSSTGGICDSPHQILDGENCTLIDALLGDPQCDGFQNKKWDLYVERSSAYSNCYPYDVPDYASLRSLVASSGTLEFNNESFNWTGVTQNGTSSSCKRRSNNSFFSRLNWLTHLKFKYPALNVTMPNNEKFDKLYVWGVHHPVTDNDQIRLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQDTLE

SEQ ID NO: 275 - protein, 275 aa, Artificial Sequence
  A/Victoria/361/2011 HA1-1L modified
ELVQNSSTGEICDSPHQILDGKNCTLIDALLGDPQCDGFQNKKWDLYVERSSAYSNCYPYDVPDYASLRSLVASSGTLEFNNESFNWTGVTQNGTSSACIRRSKNSFFSRLNWLTNLNFKYPALNVTMPNNEQFDKLYVWGVHHPVTDKDQIFLYAQASGRITVSTKRSQQTVIPNIGSRPRVRNIPSRISIYWTIVKPGDILLINSTGNLIAPRGYFKMQSGKSSIMRSDAPIGKCNSECITPNGSIPNDKPFQNVNRITYGACPRYVKQDTLE

SEQ ID NO: 276 - protein, 275 aa, Artificial Sequence
  A/Aichi/2/68 HA1-1L modified
ELVQSSSTGKICNNPHRILDGIDCTLIDALLGDPHCDVFQNETWDLYVERSSAFSNCYPYDVPDYASLRSLVASSGTLEFITEGFTWTGVTQNGGSNACKRGPGSGFFSRLNWLTKSGSTYPVLNVTMPNNDNFDKLYVWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQDTLE

SEQ ID NO: 277 - protein, 275 aa, Artificial Sequence
  A/Wisconsin/67/2005 HA1-1L modified
ELVQSSSTGEICDSPHQILDGKNCTLIDALLGDPQCDGFQNKKWDLYVERSSAYSNCYPYDVPDYASLRSLVASSGTLEFNNESFNWTGVTQNGTSSACIRRSKNSFFSRLNWLTHLNFKYPALNVTMPNNEQFDKLYVWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQDTLE

SEQ ID NO: 278 - protein, 778 aa, Artificial Sequence
  STF2.D3Ins.HA1-1L WY03 D31-o1 with mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGGICDSPHQILDGENCTLIDALLGDPQCDGFQNKKWDLYVERSSAYSNCYPYDVPDYASLRSLVASSGTLEFNNESFNWAGVTQNGTSSACKRRSNKSFFSRLNWLTHLKYKYPALNVTMPNNEKFDKLYVWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQDTLETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 279 - protein, 778 aa, Artificial Sequence
  STF2.D3Ins.HA1-1L NY2782 D3I-o1 with mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGGICDSPHQILDGENCTLIDALLGDPQCDGFQNKKWDLYVERSSAYSNCYPYDVPDYASLRSLVASSGTLEFNNESFNWTGVTQNGTSSSCKRRSNNSFFSRLNWLTHLKFKYPALNVTMPNNEKFDKLYVWGVHHPVTDNDQIRLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQDTLETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 280 - protein, 778 aa, Artificial Sequence
  STF2.D3Ins.HA1-1L VT361 D3I-o1 with mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQNSSTGEICDSPHQILDGKNCTLIDALLGDPQCDGFQNKKWDLYVERSSAYSNCYPYDVPDYASLRSLVASSGTLEFNNESFNWTGVTQNGTSSACIRRSKNSFFSRLNWLTNLNFKYPALNVTMPNNEQFDKLYVWGVHHPVTDKDQIFLYAQASGRITVSTKRSQQTVIPNIGSRPRVRNIPSRISIYWTIVKPGDILLINSTGNLIAPRGYFKMQSGKSSIMRSDAPIGKCNSECITPNGSIPNDKPFQNVNRITYGACPRYVKQDTLETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 281 - protein, 778 aa, Artificial Sequence
  STF2.D3Ins.HA1-1L Aichi2 D3I-o1 with mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGKICNNPHRILDGIDCTLIDALLGDPHCDVFQNETWDLYVERSSAFSNCYPYDVPDYASLRSLVASSGTLEFITEGFTWTGVTQNGGSNACKRGPGSGFFSRLNWLTKSGSTYPVLNVTMPNNDNFDKLYVWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQDTLETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 282 - protein, 778 aa, Artificial Sequence
  STF2.D3Ins.HA1-1L WI67 D3I-o1 with mutations
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAYANNGTTLDVSGLDDAAIKAATGGTNGTASVTGGAVKFDADNNKYFVTIGGFTGADAAKNGDYEVNVATDGTVTLAAGATKTTMPAELVQSSSTGEICDSPHQILDGKNCTLIDALLGDPQCDGFQNKKWDLYVERSSAYSNCYPYDVPDYASLRSLVASSGTLEFNNESFNWTGVTQNGTSSACIRRSKNSFFSRLNWLTHLNFKYPALNVTMPNNEQFDKLYVWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQDTLETKTEVQELKDTPAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 283 - protein, 405 aa, Artificial Sequence
  Flagellin (FljB) D3 removed native
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLR

SEQ ID NO: 284 - protein, 405 aa, Artificial Sequence
  Flagellin (FljB) D3 removed with R to A mutation
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAAVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLA

SEQ ID NO: 285 - protein, 406 aa, Artificial Sequence
  Flagellin (FljB) D3 removed mutated for some R3.2x
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAS

SEQ ID NO: 286 - protein, 223 aa, Artificial Sequence
  A/California/07/2009, HA1-2
GVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIIS

SEQ ID NO: 287 - protein, 883 aa, Artificial Sequence
  HL118 STF2.R3.2 HA1-2 B/FL4
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKASTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKG

SEQ ID NO: 288 - protein, 887 aa, Artificial Sequence
  HL171 R3.2 HA1-2 B/BR60
MAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDSLNVQKAYDVKDTAVTTKAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSVVSADAKNALIAGGVDATDANGAELVKMSYTDKNGKTIEGGYALKAGDKYYAADYDEATGAIKAKTTSYTAADGTTKTAANQLGGVDGKTEVVTIDGKTYNASKAAGHDFKAQPELAEAAAKTTENPLQKIDAALAQVDALRSDLGAVQNRFNSAITNLGNTVNNLSEARSRIEDSDYATEVSNMSRAQILQQAGTSVLAQANQVPQNVLSLLAKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKG

What is claimed is:

1. A fusion protein, comprising:
    (a) a flagellin protein as set forth in SEQ ID NO: 2; and
    (b) at least one antigen that has an isoelectric point greater than about 7.0 and is fused to at least one loop of domain 3 of the flagellin, the site of fusion to the flagellin protein between amino acid residue 277 and amino acid residue 278 of SEQ ID NO: 2 or fused between amino acid residue 259 and amino acid residue 260 of SEQ ID NO: 2,
    wherein the fusion protein activates a Toll-like Receptor 5.

2. The fusion protein of claim 1, wherein the isoelectric point of the antigen is at least one member selected from the group consisting of about 7.5, about 8.0, about 8.5, about 9.0, about 9.5 and about 10.0.

3. The fusion protein of claim 1, wherein the flagellin protein of SEQ ID NO: 2 lacks at least one of a portion of a carboxy-domain 0 and portion of an amino-domain 0.

4. The fusion protein of claim 1, further including an additional antigen fused to the flagellin protein of SEQ ID NO: 2 at a site that is distinct from fusion of the antigen to the loop of domain 3 of the flagellin.

5. The fusion protein of claim 1, wherein the antigen is an influenza viral antigen.

6. The fusion protein of claim 5, wherein the influenza viral antigen is an influenza B viral antigen.

7. The fusion protein of claim 5, wherein the influenza viral antigen is an influenza A antigen subtype, and the influenza A antigen subtype is at least one member selected from the group consisting of H3, H7 and H9.

8. The fusion protein of claim 7, wherein the influenza A antigen subtype is H3.

9. The fusion protein of claim 5, wherein the influenza viral antigen is a hemagglutinin antigen.

10. The fusion protein of claim 9, wherein the hemagglutinin antigen is at least one member selected from the group consisting of an influenza A viral hemagglutinin antigen and an influenza B viral hemagglutinin antigen.

11. The fusion protein of claim 9, wherein the hemagglutinin antigen is a portion of the hemagglutinin antigen that includes at least a portion of a globular head.

12. The fusion protein of claim 11, wherein the portion of the hemagglutinin lacks a transmembrane domain and a cytoplasmic domain.

13. The fusion protein of claim 12, wherein the portion of the hemagglutinin further lacks an HA2 subunit.

14. The fusion protein of claim 13, wherein the portion of the globular head has at least one β-sheet at a bottom of the portion of the globular head.

15. The fusion protein of claim 14, wherein the portion of the globular head further includes at least one β-sandwich at the bottom of the portion of the globular head.

16. The fusion protein of claim 15, wherein the portion of the globular head further includes at least two β-strands at the bottom of the portion of the globular head.

17. The fusion protein of claim 1, further including an amino acid linker between at least one of an amino-terminus or a carboxy-terminus of the antigen and the loop of domain 3 of the flagellin.

18. A method of stimulating an immune response to an antigen in a subject, comprising the step of administering to the subject a composition that comprises the fusion protein of claim 1, wherein the composition is administered in a dosage sufficient to induce an immune response to said antigen in the subject.

19. The method of claim 18, wherein the fusion protein of the composition administered to the subject is in a dose of at least one member selected from the group consisting of about 1 μg, about 2 μg, about 3 μg, about 4 μg, about 5 μg, about 6 μg, about 7 μg, about 8 μg, about 9 μg, about 10 μg dose, about 15 μg dose, about 20 μg dose, about 25 μg dose, about 30 μg dose, about 35 μg dose, about 40 μg dose, about 45 μg dose and about 50 μg dose.

20. The method of claim 18, wherein the composition is administered to the subject in a single dose.

21. The method of claim 18, wherein the composition is administered to the subject in multiple doses.

22. The method of claim 18, wherein the antigen is an influenza viral antigen.

23. The method of claim 18, wherein the influenza viral antigen is at least a portion of hemagglutinin.

24. The method of claim 18, wherein the composition includes an adjuvant.

\* \* \* \* \*